United States Patent 12,048,720 (COMPOSITIONS COMPRISING BACTERIAL STRAINS) - sequence listing, part 2

SEQ ID NO: 10 - DNA, 4979951 bp, Parabacteroides distasonis (residues 1,659,985-3,319,968 of 4,979,951)
accaagcaaagcccgttgttcaacgccgataagatcaagaccccgctcctgttgcttcacggcaacgccgatacgaacgtacccatcggggaaagtatccagatgttcgccgccttgaagatcctagggaaaaccgtggagttcgtgcaggtggatggcgagaatcatggtatcgtaggctatcagaaacgtataggctggcaaaataccatctacgcatggttcgccaaatggctgaaagacgagccggaatggtggaaagccttatatccggatcgtactttataagaatatttatttgaacgaaagcgtctgtgtctcccgcaagggaatcgcaggcgctttattcgtttgctcaaccccggctgtcatccggatcagctccgtttacgaacggtaattttgatacaaagatccgtaatatatatacatatacttgagataaatccgaatatctttgtgatgtcaaacaataacgatatcctcatgaaaacaaaagcaatcgcactcttcctgctaggcttcataccagccttcgcacaagatatcccaacttctaaaacagaacaaaatatggacagaatcgaacgctgtaaaaagaattacaccgagctattcggaggcgaggcattgaccggacaaggaacagatccggaaatgatggacattctccagaaattcatcttcggggaggtattccgcacaggagatcttgataaaaagacccgggagcttatcacttgcaccatattagccacgatgcaaaccttgccccaactgaacgcccacgccaaagcggcgctaaacgtaggcgtcactcccatcgagctacgggaggcgatatacctatgcgctccgtttatcggtttcccgaagacattgaatgccttaaataccatcaacgaagtctttaagcaacaaggcatcgctttgcctctggagagacaagctaccgttacggaagaagatcgccacgagaaaggacaagccatacaaagccggctttacggcgagggaatcaaagaggccatgaggaacgtcccgggaaatatgggtccggaagtagagcgattcctcaccgaattctgcttcggagatatctatactcgcaacgggctagacctgaaaacccgggagttactggcttattgcatactaacgacccttgaagccgaaagccaactacactcgcatctcgaagggaacttactggccggcaatagcaaggagaccttaacggcggcggttatacaatgtcttccttatatcggcttcccttccgctatcaaagcgttgaaaatcattaaggaatcctctcagcccgccccaaagaagaacttagtccgcctatccaagatcacggtcgatcccgcccagttggagcgttataacgcctttctggaagaagagatcgaggcttccatgcgtctagagccgggtgttcttacactgtatgccgtatcggagaaagaacatccaaataaagtaaccatcctagagatttacgcagatcaagacgcttataaaagccatatccaaacgccccatttccagaaatacaaacaaggaacattacagatggtgcaagagttggagctggtagatagcacgcccctgatccccggactaaagataaaataaaacaagaatccccgctttccggcacgaagccatctaagcggggatttcatatatccgtgaaaatctaaatgacttgttattcgatcatttgatattcggattcaatttatgccattcggaaatagcgggaagcacgcccatagcgatcacctcgtcacgtaaagcgcaaaggtgcttgtagctcttctccaaggcagcctcttcttccggtgtaccgtgcacctctttcaacgctacgccgtctttcgtaattgaggtctcccaagccatcatgatatgatcgaacttaccgtttgatacataagcgccagccggccaacggaacggtttaccacccatcgcagctgcgatcatctcgatagatacatatgacgggctttggaaggaagaacggccccgcaaagcgataatgttagcgccacccttcgtaaccttggtttgtatctccgcccattgatctttcgtcaaggcatccgtaccgataagttccgtcaaaggcttgccatccaccttagcggtagaggcgaaaacagccatttgctcgccatgaccgccatacgtacgacaattctcaacctgatccatagagataccgaaatgttttgccaactcactgcgtaaacgagttgaatccaatgcggccaacgtcgtaacctgagaaggtttcaagccggaatacaataaggtaatcaaaccggtaatatccgccgggttaaaaataaccacgatatgctttacgtccgggcaataagcctttacgttcttgccgaactcctcggcgatagcggcgtttccttttaggagatcctcacgggtcatacctgcctttcttgcggcaccaccggagttaacgatatatttagcgcccgtcaaagcctccttgatgtctgaggtaaaagtgatgtttacaccctcgaaaccacaatggaataattcctcggcgactccctccaaacccggtgcgtaagggtcgtacaaacaaatgttagaagttagtcccatcataatagcggtctgtgccatattagaaccgatcatacctgctgcgccgacaatcgtcagcttctcgtctgtgagtgttttcataagaaaccttgtttttaaatgtttatttttcttttcgacacaaagatacgagattgagaactcttgtcctaatcataaaaacgaatcccccataaataaaagttatgaatagcgtctctatgattattccaagattatcacgtacctttgtattatgaaaacatttaaactagacaattggttgcccacgacgaagaaagaagtcgaggcacggggatggggttacctcgacgtgatccttttctcgggagacgcctatgtggatcacccctctttcggggcggccgtgatcggtcgtgtattggaagcggaaggattacgggtagcgatcgtaccgcaaccggattggcggggagattaccgggatttcaagaagctcggcgttccccggcttttcttcggtgtatccgccggtgccatggattcaatgatcaaccattatactgccaataagcgattacgcagcgacgacgcctatacgccggaccaacgtccgggaatgcgtccggactatccgagcatcgtctatactaaaatactgaaagaattgtatccggatgtccccgtcgtattgggtagcatcgaggcctcattacgccggcttacgcattacgattattggcaagataagctattaccgggaatccttgccagtagcccggccgatttattgatttacggcatgggcgagaagccgatcaaggaattggtgcgccgcctaaagtccggcattcctttcaacgagatcaagaacatccgccaaacggtttatctggcagacaaagaggatgcgaaagacgacgatatcgtgctcttctcacatgaggaatgcctaaaagataaattgaaacaagcgaagaatttccggtatatagaagaggaatccaacaaatacaatgcctcacgtatcttgcaaaaggtaggaaaacaggtgatcgtagtgaatcctcccttccctccaatgacggaagcggagatagatgcttcctacgaccttccctatacccgcttgccgcatcccaaatacaaagggaaagtgataccggctttcgagatgatcaagttctcggtgaatatccaccggggttgtttcggaggatgcgcgttctgtaccatatcggcgcatcaagggaagttcatcgcctcccgaagcaaggaatcgatcttgaaggaagtgaaagcgattaccgaaatgcccgatttcaaaggatatctaagcgatttgggaggcccttccgccaatatgtaccgtatgaaggggaaagatgagcgaatttgcgccaaatgcaagaaaccgtcttgtatctcccccgtcgtttgcaagaacttgaacgcggaccatacgccgctactggatatctacaaagcggtagatagacttcccgagatcaagaagtcgtttatcggaagcggtgtacgctatgacctgttattgcaccgttatgcggatgagtctttaaacaaggcagctcaaacctataccgaggaattaatcgcccgccacgtatccggccgtttgaaagtggccccggagcatacgcaagacgaggtgttgaaacaaatgcgtaaaccgtctttctcgcaattcggacagttcaagaagatattcgataaggtaaaccggcaatacgggttgaaccagcaactcatcccctatttcatttccagccatccgggatgtaccgaggcggatatggcggagctggcggtgatcaccaagagcttgcatttccagttggagcaagtacaagacttcacgcctacgccgatgacattggctacggagatgtattataccggatatcatccttatacgttggagaaagtatatacggcccgctcaaaagaacaaaagttggcacaacgccagttcttcttctggtataaacccgagtcacgccgtcagatcatgcaagtattgcaaaagatgggacgaaaggatttgattgagaaattattcggacagaggggtgacatgaatcccgctcccagaaaaagaagataataggcttttgagattagctgtatcgatgaattacgagagtagtcgcatcgtatcacgggagtagtcttgatggataacgagagtagtctcgacaagcgatgagactactctcgttattccttatgattattctttcacggcgatcacctcgatctctaccaaaccattcttcggcagtgtcttaacggctaccgccgaacgtgcgggaaacgcaccttcgaactgagaggcgtatacctcgttcataacggcgaagtcgcccatatccgctaaaaatacggttgtttttacgacatcattgatgctataacctgcctctgccaagatagcgtgaacattcttgaacgcttgggcggtttgttcctttacggatccctcaacgaaaagtcccgtagcaggatcgatacccagttgtccggaagcgaacagcatattacctacttgcaccgcttggctatacggaccgatagcggcgggagcgttttttgtagcgataactttcttcattttcttctttagtttatatacatattattattgttgctcgttcatacgttggcgaaccacctcgtacaccagaatggaagtggctacagatacattcaaggagccgatcgttccgaattgcggaatctttaccatattatcgcagatgcgcaagttctccggagacacacccgtatcctccgctcccatcacgatcgctaccggtccttcatacttcaccgccgtataattctccgccgctttctcgctggcggcaaataccttcaccccgctttgctgcaagaaacggatcgcttggttgatactcttctccttacaaaccggcaatacatgcaaggcaccggcagaggtcttgatcgcgtcggcgtttaccgaaacgcttccttttgccggaatcacgatcgtatcgactcccgcacactcgcaggtacgggcaatagcgccgaaattacgcacgtccgtaaccccatccagcaatacgatgaaaggatcttttccttgctcatacacaaaaggaatgatatcttccaagctctggtaggtaaccgccgacataaaagcgatcaccccctgatgattctttcgagtcaaacgatccaagcgttcagccggaacacgttgtaccggtatctcacggcctctcagtacctcaaataactctttggatagatccccttgtaaatcccttttcacaaggatcttatctacctccttatcagcctgtatagcctcaatcacggcacgaatgccgaacaccatttcgttttctttcatactttatataacgcaaaactattaatttcacaaatgtagggataaataatcaattcttcaaaccttcagccttcgcataacattcccggcataaaggctcgtattcggattgttcccctaagaagacccgtttatcatttcccacgatacgatgggatacgtaagccaaacgtccgcatttcacgcagatggcatgcactttcgtcacctcatcggcgatagcgcataactccggcataggaccgaaaggaactcccttatagtccatgtccaacccggccacgatcacccggataccgttagcggccaattgattgcatacgtttaccaatccctcgtcgaaaaactgggcctcgtctatccccaccacatcgatctcggaagtgaacaataggatactggaggaagaatccaccggagtagaaggaatcgaattactatcgtgcgagaccacgttatcctgcgaatagcgggtatcgatcgcaggcttgaaaatctccacccgctgcttggcgaattcagcccgcttcaaacggcggataagctcctccgtcttaccggaaaacatggaaccgcaaatcacctcgatccgcccttgtcccggatactggaatatatgctcttctgaaggcaatgtcatcactttctctttttgtccgcaaaagtacataaaaaaagcggaaccatggaagcttattcaccccatccccggtttgtctttcactgcaacccgggttgcagtactactgcacaaggcttgcagtgtcactgcacgtgggttgcagtaaaactgcaagacgtgttgcagtaatgccgcgaggcaggttgcagtaaatattacgactacaatccatcggtgtaaggcatcgatcgcacgcctcgttataaattaaagttgggccggtctattttccagttgagcgacggtatcttccggttcagtaaaaatccgccttattccctcacctattgcctctatttttgcccggtaacaaataactaggtatatcttatgagaagaatttcatacatcctgcttctgggcatccttttatcggcatgccaaaagaacacaaagtccgaaggcacgaacttacctgtcgaggttatctctccaataaaaaagacagagaccgacagaagtcgtgaatacacctttttatcaaggccctataatgagacagtcctatctttccgcatcaatggccccgtcttgaatttcgacttacggcccggacaagcgttctccaaaggcagcacgatcctctcgatcgataaccgtgacttcttgattcgcaagcagcaaacagaggcgctctactcgcaaaccaaccaagagtataaacggatcgaggccctttacaaaaagaataacatctccggaagtaattatgagaaggcgaaagcggatttccttgtcgccaaatccaattacgagaccgccgtcaacgccctaagcgatacccatctgagcgccccttacgacgggtatatccaaaatatccatatcgaacctttccaagacgtgaaagcgaccgagccaatccttaccttcatagaactggacaggctgaagatcgagacctatataccagaggaagtcgccttacacttatatgataaagaaaaacagaagctatgtcaaataggaatccatttcgatacggctcccgaacggacaatcaccccttccaatttatatgtgtctaaaagtacgacaaacaataacctctcttatctactgaccgccattatccccaaccccgatatggaatggctgggcggaatgagtggaatcctctcgatcgacctacccaaagaagagcggtctcaaaatctatggcttcccttaacggctatctgtcatcgcccccaaaaaggagattatgtatgggtggttaaaggagacaaggttaactccgttcccgtcaaactcggtgagcaaagaaataaccagatagagatcgtggaaggaatcacggaaaatgaccttgtcgtattgacaaggcaacgtttcctttccgaaaatagtaccgtaaccatccaaaaataagtaagatgcaaaaattcatcaaatatttcctgaaaaacaaagcggttacatggctcctgctagtcctgatcttggcaggggggctgttctcttacgcaaagatgggaaaactggaagatgccccgtttacgatcaagcaagccttggtacttaccccttatcccggcgcctccccctcggaagttcagtcccaagtgacggatgtgctggaagaagccattcaatccttaggcgagttatactatctgaagacagagaaccgggctggactttccaaaatcacggtctacgtgaaaaaggaaatccgggctgatgagatgcagcagttatgggataaactacgccgaaaggtaaacgacgtacaaggcaaattaccttccggagcgggaacctccatcgtcaatgatgattttggcgatgtattgggtgttttctacggattgaccggagaatcttatacctaccgggaactggaagatcaagccaaactgatcaaagacgatttactgaaagtaaaagacgtggcaaaggtagagatctacggcatacaaactcccgtaatcgatatccggataaaccccacgatcttatccaatcggggtattacgacagctgatatcaaacgggcgttcgacggacagaataaagtggtagacgccgggagtattcgcaacggggagactcgcatacgtatcgaatccaccggtaatttttactccttggatgatatccgtaaccttacgatcgtatctcattccggcgagcatttccggctaggcgatatcgcccgtatcgaagagggttaccagactccgccccaaaacttcatgcgcatcaataacaagcaagcggtcggtatcgctatctctaccataccgaccgggaacgtggtcgatatggccaaggccgtgaaaaagcgtattcaatcattttcggagaccatgcccaagggttttgagctcacctccatatacgaccaaggatatgagtccgccgtggccaaccaaggatttatcttgaacttgatcatctccgtcgtgaccgtagtagcgatcttattgttctttatcggtttcaaaaacggccttttgatcggtagcggattggttttctctatcttcgccactttaattgtcatgttcgccaacgggatcgccttgcaacgaatgtctcttgccgctatcatcatcgcgatgggtatgttggtagataacgccatcgtagtatcggactctgccttggtaaatatgcaacgaggcatgcgcaaacgtatcgcgatcatgagggcttgctcatccaccgccctgcctctactggcggctacggctatcgcgatcctcacgttcttgcccatttactattcaccgcatatcacgggcgaattactttcatccttagtgatcgtgatcggagtatccttgatgttcagctgggtgttcgcacttacgcaaaccccattcttcatccaagagtttgtacggcgccccagaccggacgagttaacaggggaattattctctggaaaatactatgattattttcggtcttccctacgccttgtcatcaaataccgatacgctacagtaggtagcttatccgttctattggttatctccgcatggagtttccagtttatcccgaaagtgttcgtgccttcgctcgataagcagtatttcactttagatatgtggctaccggaaggtacagccatcgaggaaaccgatcgatacgctaccgatatggccgaatccatccaagaatattcgcagacggaaatggtttcctcttatatcggacggacaccgccccgttattatctatcgaacgttagcttcggtccccaaccaaactatgcccaattattggtaaaatgcaagacatccggagaggcccgggaattgcatgccttgctacaagactcaattcgcttaaaatatccggaaccgctcatcaaggtgaacaagtttgagttaagcccgcttacggaagccttgatagaagcccgtttcctcggaccggacccggcggtattggactctttgaccggagtagctatcgacattatgcgaaggaacccgaaagtaaccgatgcccggaatgaatggggtaatatgacctatatgatacgcccggtatatgatccggtaaaagccggtttcttaggtatcaccaaggctaatttgatggaatccgtcaaatccatcgaggaaggtacggttatcgggatttaccgggatgaggaaaagaaagtcccggtcttattgaaatcggagaagagcggaatcgacgatccccgttcattaggtgatttctcggtgtggaacggagagaaatccgcacccttgtcacaagtaacccgacaggtaacctccgcatgggaatatccgcagatcaagacctacaaccggcaattgtctatggcagcgatgtgtggcgtgaaaaacggttacaccatgtctgaggtacacggtgagattcgggaagagatcgagaaaatgaacctgccccaaggatatagcttcttctgggattcacaatataaagaccagacagagggattgcaagcccttgtcaaattcttcccgctggctttcttgatgttggttgttatattggtcgctttattctccaatttccgtcaaccgataatcatcctttgcgtgctccctctctccttaatcggggtagcgatcggtatgttacttaccgggttcgatttcggctttttcccgatcgccggatggttggggctcttgggtatgattatcaaaaacgtaatcgtattattagacgagattaacacgcaacgtcgtaacggtatctctccatacgactcgatcatagaggcaaccatctcaaggactcgcccggtcttgatggcggctaccacgactattttaggaatggtgcctttacttttcgacgtagcgttcggtggaatggcggcgactattatcttcggactcaccttcgccaccttacttacgttattcgtaaccccgacgttatacgcattgttttaccggattcattcacctcacaaataaacgataaaaatggacaaagtatatattatcagcggtctcttatccttcctatccttcccgttaatcgcacaaaacagcgattatcaagcgcaatatagggaaaaagtcttggaatacaaccaagacttgaaagcagcgggatacaacgaggccatgaaacaggaaatgatcaaatcggcccgtgcggatttcaaaccgaaactctcggcggaaggtaatttcaattataccggtaatccgctagaattatcgattgatttgccatctatgaattcccccctttattttcaaggtaaagatctgaaatatggggcgactctctccctctcgcaaccgatttataccggaggcggcattcgtgccaactaccaaaaagcacgacaagaaaaagagttggcatccaatgaatccgatcgtataaaaagcaataccctacacgacgccgatatctactattggaatgcggtagcccagcacgagctggttttcgtggcacaggcatttcgtacatccatacagcaactggtggacgtcgtacgccaccgggtagaagtcgaatacatcgatcgaaacgatcttcttatggcggaggtaaagctaaacgatgcagatttccagttattgcaaactcgtgataacgccgagatcgcacgtttggcccttaattctttcgctggtgtaaacccgagcgataccttgccgatcgatcattccgtaatcgccctcaaacaatttatccctttatcggatgagatagataatgcgataaccagcaggccggaataccggatcgccaaaaacaagatcgagttacaggaatcatcccggaaaatagcggatgcccatttcttaccccaattccatattggagtagatggaagttattcctcaccgggctataacttcaaatccgacctagatccgaactatgcgatctacgccaagctcagtatcccgctcttcgaatggggaaaacgtaagagtacccgcaacgcttcctcgtacgccatcaatatggctcaacagaatctcagcaagacgcaagataagatccggctggaaatacaaaccgcccattacaactataaacaagctatcgataaagtcgaactaaccgagagctcattatcaaaagcatccgaaagtgagcaaatggccatggagcgttataaggaggggaatgtttccatcgtcgaggttatcaacgctcaattatatcatcagcaagctcaggttaattatatacaatccaaactaaacgcacagatggcgaagacggatttcgaacgggcaatttattatcttcgcgaaaaagaataggtcatgaaagaaatatcatacgggaaatcggcatgtatccttttgttttcggcattaggggtcttttcctatttcttgctgttatatcatacggagctacaagagcgcatccccgatataaagatctcattgatcgctttgtccatcacgatagcggtattcaacttgttcggtttcagtttactggtcagcagccattggatggctaccaactatccattatattatatcgataaaagccggatgttatggcattatctgctggtagcgatcctattgctacttatgaattgtaccctgtttatctcgttgaaatggatcacaagcattggcgatcctttcgtgatccgggcaaaaggggccggtttggtaatagccgtctggttcgtggagatgatcattttcagccttctcttgattaattattcgatgcgttatacattgaatttatataaggagaaacaaagattggaagcagaatctatacaagctaaatataccgctctccaaagccagctaaatcctcatttcctattcaatagcttgaatacattgatagcagagatagagtatgatccggctacggcggtcaagtttacgcagcatctatccgaggtataccgttacgtgctccgccagcaacagtgccagatcgtctctttaaaagaggagcttgattttctggattcctatatattcctccatcaagtccggctgggagattgtttgtcgttggaacgcgatcttcccgacaacgtcattgaccatcaattgccccctctgacactgcaactactagccgagaatgtcgtgaaacataattatatcgacgattttaacccgatgaccatacgggtatatactgaaaggaacagtcgatatctatgcgtcagcaatacattacggcctaaaaaagtctcaaacgcatccggtaaaggattaaagaatttgtcggagcgttatcaattactatgtaagcaggatatccagatccgaaaaaatgatcaccaattcaccgtatcaatcccacttatttatgaataatatccaagtagccattatcgaagatgagaaaccggccgcccggttactggaaggtatgataaagaaattacgcccgcaatgggatatcatcaagatacccggaagcatcgaatcatccgtggcttggttcgcttcccatccgcatccggatatcgtttttctggatatccagttgtcggatggaaattcttttttatttatagaacaggcttgtcctacaagtctcattatctttacgaccgcttacgatgaatatgcagtccgggcctttacggtaaacagtattgattatctactcaaaccgatacgacaagagagattggaggaagccatccaaaaattcgagcatgtcacgtctaagtacaaccagaagctcttagagcaaaatgatttattggaagtactccattccctcacgtatcccggcaagaaatacaggacccgtttccttatttccggcaacgagaaactgatcactttacaggtggaggatatcgcccacttttattcattaaacaagatcaccttcgctgtcacacgccaaaacaaggagtacataatcgatttcccgctggataaactcatggaacaattagatcccgataaatttttccggacgaaccggcagacgatcataaatatcgaatccatcgtgaaaatagagccctattttcagaataaggtcattgtccacataaagccggaacataaagagaaaatattggtcagcaaagaaaaatgggcctctttcaagctatggttgaattattagacctttcgcccattgctataataccgttcttttctatcgtcccgatccttcttattctttttaggtttgggcttatccggtttcgctggtttccgatagtcatgacgatggttgtcacgatcccaatgtctatctgagtcatgccggtcgtctctccaatgattgtcatggtgaatggtaccccagcggtaattccaatagttatcctcatatcgacggcagtcatgggacgggcggcgatccggatatctcggattcgcataccatccccgataatcatggatacgttgcggatgctcccttacaaaacggacatatagattgaactgggccggagtcaatagacgttggatcttacgatccctttccatacgcaaatcgtaaatacggcgagccgcacggtcccaataccgatagtcacggcgggcctccttctctattttctgtccgtacttatggataatcttatggtattccgctgcttggcgagcgggcaaatgcatcgcttgctccatccaaagacaattttgacaatgcggttcattccacccaaaactgatccaaaactggctgtaagcgggtaaactgcacaatatagccaacacacatagtaagctgaatcgtttcatgtcttttcaattttaagttaataataaagcgaatcgtttgttcttttatctaagactgccctacttcagaaaggtttaatccttgatacccaacaaatctttcgcattggcaagagaagcctctgtcaacgaggctccgctcaacatacgggccacctcgttcacacgttcctccccctctaattgcttgatacgggtcagcgtacggtctttggtatccttcttataaacaaaataatgagcttgccccttcgccgctatctgaggtaagtgagtgatagcgaaaacttgcatctttgttccgagttcttgcatgatatcccccattttatcggcgatatcacccgatacccccgtatctacctcatcaaagataatagtaggtaaagcggtgaacccggcaatcatagccttaatgcagagcatcaaccgggagatctcacctccggaagcggtttgggctaccggctgcaattccgcgctcttattggcggagaacataaatcggatatcgtccattccatcgctctccggctctttgcgaggaaggatgtccacacggaaacgggtattcggcatccccaacggaataatcatcttgaccaattgcgaggccatcgccgtggaagcgactttacgctgctcgctaagcacggaggcttgttgaagcaactctttatacgaggcatccaattgactctctaacaaaccgatttgctcatcgaaagaatcgatcgcacgcaattgctcttggtattgatcccgtatagcaatcaattcatccacggtggagacacggtgtttttgcagaagtgtataaaggatattcaagcgttcattcacccattccaatcgttccgggttgaactctacatcttcctttaaaacgtctgtctcggaagccagatcattcaagtcgatataagccgagcggattcgctcggagatctccttggctttcgggaaatatctttctaaggaatccacggtggaaagggcttccttgagtatttggatggctccttgctcctcgccgtccaagagttcggttaccttatataaagagcttttgatctcctccgcatgcgagagagtttcttgctcttgctccaactcatcctgctcatccggttgaaggttggcttcgtccaattgttccaattgaaaacggatatagtcctcctcctgcttgctttgagccgctttgtccctcaaatctttcagttcccttcgcaacgcctgataacgagtaaattccttcttataaagaatgagcaagatctcattttcggccattacatcgatcactttcagctggaaacggttgtcgcccaacaataggttctgatgctgcgaatggatatcgatcaagcggcttcccaactcttttaagatcgtaagggaaaccggagaatcattgacgaaggcacgggatttgccggaggcataaagttcccgacgcaagatacagctatccgcgtcgtactcaaggtcgttacttaggaagaaaggctccaactgatattttgagacatcaaatacggcctcgatcacacatttatccgaacctttctttatactcttgccatccgcacgctgtcccagcaccaaagacaaggctcctaatataattgattttcccgctccggtctcacccgttatcaccgagaagcctttatcaaagcggatatccaaattgtctatcaagacaaagttctgtataaataaggatttcaacataactattttaccttactggtttttgaagctcttccaagcgagtggattgtgccggatagatctcgaacagcatcttatagccctcttgccgctcttgtgtggtcgctttcgaataaattgcgataatctcatctaatttagcgtcggcgaacatttgtagaagcacagaggtaggccgggctttctttacttcctgcaaggcgggaagcgcactaatgatcgtcgtacgtccacgatccggatttgctgccatttcatcgagtcctttccggtgatacgtgtaccacatttcccggaaagcgtcggatgcgttatcttgcaaagccgtcgctacggcatggcggttctggttgctatcaaaagctttccagcccgtccacgacatctcagactgggccatgttcacgatttgctgggcttgttgtatataggtagttccacctttcggagcgaaactatcgaaatcaagccccaagatcacatagacgtaaaacacgatagtggccgtaagattgctggtcagcgtatttgagttatagtccaacggctcgccctccgtatactcaaaatccaactgttgatccctgaaattcagaagagtagttgtataactggaattatagaccggacggcgggcttgtatctggatctcgctcttgaagttcgtctcatccaattcattcacgataatcgtcatcgtacaatcgatcttctcattgacggcaaacgtggcatccgtccatttccggttattcacgaactcagtcaaggagttctgtaaggtcgtgaagatttgcttgttagcggtcgcaattttgtctccgttcaccgtgatacgggcgttcaactcttgcgccttcccacaaaaaggagcggcgcaaagcatgaatagataaaacagtcttcttacttttctcatttcaataatgttaccaacttatttacgatatcacaggctacctcccgcttcgttttgagcggatagctcgttactcctccggcattgtcgataatcgtgatcttattggtatcgcaacggaaaccggcaccttggtctcgtaaagaattcaagacgatgaaatcgagattcttccgcttcagtttaccttcggcatgagtagcctcgtcgttcgtctccaaggcgaaccccaccatgacctgtccttcccgcttgatcgcacccaaagaggcggcgatatccgggttcggaaccaaatgaagcgtcatctctctctccgtttcccgtttgatcttctgctcggaagcattctccggacggtaatcggcgacagcggcacataatatggcagcatcgctactcgggaatgcggtcatcgccgcttggtacatttccccggcagactcaacatcgattcgtttaatagctggatgatgtgtttttaaagagactggaccagcgaccaaagtcacctccgcccctctctccgcacaagcttccgctaaagcgaaccccatcttaccggaagagtaattacctataaaacgtacgggatctatcttttcatatgtcggacctgctgttattaagatcttttttttttcaagatctttttgagcgaaaaagaagtcttccaaaacctcgataatcttatcgggttcttccatccggcctttaccaaccaaatggctcgccaattccccctcggcaggttcgataatccggttaccgaatgaacgcaagcgctccagattctgttgggtactcggatgagcgaacatatccaaatccatggccggagccacgaatacaggggatttgcaagaaagataagtagttatcagcatattatcggcgattccgttcgccatcttaccgatcgtggaagcggtagccggagcaatcaacatggcatccgcccaaagccccagatccacatggctattccatgtaccatccctattggaaaaaaactcgctgattacagggtggctactcaacgtcgataacgtaagcggagtgataaactcttttcccgccggcgtgataaccacttgtacctcggctccttttttcaccaatccccggatgatataagcggctttgtatgcggctatactccccgtaatccctaatataatatgtttatctttcaatgtcatatatcgaatcaatttatctttgccagtagagacgtagcacgttgcgtctctacaacctcaacaaaagaatctctttggctacttttgagtttatattgccatattcgccaagtttccatcccattcgatcgataggttccaccaaagcatccaagtcggactccttgatcccatagtcggaaagacgggtctttaatcccatgaaatggaaaaaatcttccgtagcctctattgacttttgcgccttttcatcggcagatccttcggtaataccaaatacgacctctcccatccggatcagtttcgccgctttctccttacgcatataggtcatgacacccggcaagataaccgccaaagtctgggcatgatccaagccaaactgcgccgtcaatgcatatcccatacggtgtgaggaccagtcttggggtactccttggccgatccaacagttcaaggcattcgtagccgcccacatcaaattagcacgaatatcataatcattcgggttttgcaagaccttgcggccttcttccacgattgtcttcatcaatccctcggcaaaataatcttgaaccttagcgttcaccggataagtcaggtattgctcgaccacatggataaacgaatcaacgacaccgttagccacctgtcgctctggtaaagaataagttacctgcggatctaagatagcgaacttagggaacaccaacggagacatgaaattcaatttctcatgaacagattcccgggaaattaccgcccgttcattcatttccgaaccggtagcggccaaagtcagcactactcctaaaggaagcgctttctttatcacgccacctttcgacaagatatcccaaggatctccctcgaaaaacgtagccgaagcgataaatttcgtagcgtcgatcactgatccgccgcctaccgccagcaagaaatcgatattctccctcttcaccaactcaacagccttcatacaagtctcataacggggattcgcctcgataccaccaaactcataggtatggaagtctttcaaagctgccgtcacctgctcataaatgccatttttcttaatgctaccgccaccgtataccaccagaaccttacttccttctggaagtaacgcagacaaacgggcaatacttcctttgccgaacacaacctttacaggattgcaaaactcaaaattattcatcgccttattttgaattaaagtctctcaaacggatctctgtcaacattttcttcgtattcaacgggaaatcgccattcatgatccaagaataataacccggatccgacttcaagatctccgttaccaaacggcctttatacttaccgaagttaataacctcctcgcctttatcgttgtaaaccatacgtccggcgaaatccacattattcgagtagcaggaatattgggaaaggaaagctacgtcattcttcaaatccggatagcgatccagctgcgctttcaacacctcatacgtagccaacgtatcagcctcagccgtatgagcgttctccaagcttttattgcaatagaatttataagcggcagataacgtacgttgctccatcttatggaaaatcgtctgtacatcgataaatttgcgccggttcaaatcgatatccacacccgcacgcagaaactcctcggcaagcatgggtatatcaaaacggttggaattatatccggccaaatcacaaccctcgatctgggttgccaaagatttagcgatctccttaaaggtcggacaatcttttacatcttcatcggttatgccatgaatagcggtagattcggggggaataggcataccgggatttatccggcgtgtcttcgtttcttctttcccatttgggaagaccttcacgtaggaaatctctacgatacggtcctttacgatatttatacccgtggtctctaaatcaaaaaagaccagcgggttccttaagtttaactgcattatttatttattagtcattcaacatcatcggcatcagcaacatgagcaagtcctcgtcctcatcattctcagaaggaacgatcaagccggcacgtgaagggtccgctaattctaatacaacctcttccgagctgatatttccaaggatctcgatcagatatgtagccttaaaaccgatgcttaactccgtcccgtcaaactgacaaacaatacgctcttccgcagaagtggagaaatcgatatcttgggcggaaaccgtaatcaagctatccttcaagtgcaacttcaccaagctgctcgccggattagaaaagacagaaacacgctttaaagcattcaagaaagagatacgatcgatcgttaccttaaacgggttttcttgaggaatcacactattatagttcgggtaacgcccctcgatcaaacgacaaaccatctcgaagttcgtgcaagtaatatacgcattgttatcatcaaacttaatcaatacttgctccgactccttcgccaacaaattcttcaataaattagccggcttcttcggcaaaatgaaagaagcccgttccggggatttcaccgccaagttacgcaagcgaaccaatttatgtccgtctgatgccacgaacgtcaaatcatccgtatggatatcgaaatagacaccattcattacagggcgaagctcatcatcggctgtggcgaacaaggaacgactgatgccgtttaacagcatctgggcatccatcgagatagagatagcgttatcattcaacggcttctgctgcggatatgtgtcccctttctgaccgataaaattatactttccattctggaaatgaatgaaaatctccaaattctcatcattgatatcaaaagtaagcggttgttcgggaagctctttcagcggatcgagcaatatcttggcggaaaccgcaaagagtccggcaccttgggcattcatgacgtctacggaagtcaccaaccgggtctcggcatcggaagctgtcaccgtaagcgtatttccttctaggttaaaaaggaagctgtccagaatcggtaaagagttcttggaagcgataaccttgcttatagactgtaaacgtgataatagcgcagtgctggatacatcgaatctcatagctttaattattttatcttgttatattattatttcatacaaactaccatttggatgggaagagacggggcatgccctgtctctacaaattaacccaacaaaattaagaaaatattttgtttgtaaccaactatactttcaaaagtttagggcataaaaaaagctcccctccgctttatcggagagaagcctcttatattcttttaattcgctaatttattatttagcgaaataatcttttactgcttcgttagggatcatttcttcttggaagatgtatgcacctgttttcggagacttaaccattttaatcactttggaataagtacgaccgtcacctttcttaaatgttgcaactgctttttttgccatcgtttaaaatctcctattacttaatttctttgtgtaacgtcatcttcttcaaaaccggattgtatttcatcaattccaatctctgagtagtattctttctattcttcgtagtgatatagcgagacatacccggcattccactttccttgtgctctgtacactcaaggattacctgtactctatttccttttgctttttttgccattttctatatcctccacaaattatgcgttcaaataacctttttcagccgccatcttgatagccgcatccaaacctaacttattgattgtacgtaagccagccgcagatatattcaagctaacccagcaatcctgctctacccagtagaacttcttcgtaaacaggttgacattgaacttacgtttcgttcttctctttgagtgagaaacgttgtttccaaccattgctctctttccagtaatttgacaaattttagacatttctaatctgttcttttaaattatacgaaatttaagtcaactcctgctatgtgtcttccctttctgaactagcatcatgaacaaaaacgaagattctaatagagtcttatctttacagggtgcaaaggtaagaattattttgatttatccgcaagaattctcaaatattttttcctcaacaaatcatgtcttaaattagttataggtatataacaacataacatgatattcattatggcaagaagttttaaagaagcgatccagcatcgccggacacattatggaataggtaacaactctcccatttccgacaacgagattcatgagattattaagacagcggtcactcacgttccctccgcattcaattcgcagtctacgagaatcgtactgctactgggtgaaagccacaagaagctttgggaaatcgtaaaagacacgcttcgtaaaatcgtccccgccgaagcctataaggctaccgaggcaaagatagataattctttcgaggctggctatggcacggtcctctttttcgaggatacggcggtagtagaaggcttgcagaagcaattcccttcttataaagataatttcccggtatggtcccaacagacatcggctatgcatcaactcgcgatatggactatgctggaagacgccggtttcggcgcttctctgcaacattacaacccgttgatcgacgaggcggtcgctaaacaatggcatatcaatccgaactggaaactgatcgccgagatgccgttcggtacctctacgcaagaaccgggagaaaaacaattcgccccattagaggaacgaattttagtattcaaataattataattaatgtatatggaatatgacatagcaatcataggcggtggacctgcgggttacaccgccgccgaaagggcttcggagaatggattaaaaacgatccttttcgagaagaacgctatcggtggcgtctgcctaaacgagggatgtatcccgacaaaaactcttttatactccgccaagatactagacagtatcaaaagtgcctccaaatatggtatagtggcgatgaaagacccaagtttcgacttggcaaagattatcgaccggaagaacaagaccgtccgtaaacttacgctcggggtaaaagcccggcttacgggtaacggcgtcaccatcgtagaaggagaggcacgaatcaccggagaggagtttggaaatatacggattcactgtgatggaaaagagtatttagtgaagaatgtgttagtatgtacaggctctgaaaccgtgatccctcctatcaaaggattatctgaggtcaagtattggacttcccgggaagcccttgatctcaacgatttgccaaaatcgttagcgattatcggtggtggcgtgatcggaatggagttcgcctcattctttaacagtatgggcgtaaaggtgaaggtaatcgagatgctacccgagatattagggaatatggataaagaaacctcagcgatgcttcgatccgagtataagaaaaaaggcgtagagtttttcttgaataccaaagttacagaggtatccgcagagaaagtctttgttgagaaaaacggcaaggcagacacgattgaagccgataaaatattggtgagcgtgggccgccgtccgattacaaagagtctgggactagaaaatctagcgatcgaaatacaaggggccggtgtaaaggtaaacgaacatatgctgacttcccatccacatgtatatgcggctggagatattaccggtttttccctgctggcacatacggcttaccgggaagcggaagttgccatacaccatatcctaggcataccggacgagatgagctataaagccattccggcggtagtttatacgaatccggaattggcgagcgtgggtaagacagaagaggaattggtagcgaatggggaaagtttccgtgttcaaaagatcccgatgacctattccggacgtttcgtcgcagagaacgagaatggtaatggtttatgtaaactgatcacggacgacgaggatcgtatcatcggttgccatctactagggaatccggcatccgagattatcgtcaccgccggaatcgctgtcgagaatggttatacagtcgatgaatttaagaaaaatattttcccgcatccgacagtcagtgagatcctccacgaaagtttatatatctaataaaacgcctaactaaaacagtttcctgatgctttgcattcacaatacacaaacggatccatacttcaatttggccgccgaagagtatctgctcaagaatttcaaagagaatattttcatgctttggcagaatgaaccatcaatcgtgatcggtaagcatcaggatgtatgggccgaggtaaatctcaaattcgtacaagaccaacaaatcaagatagcacgcaggttttccggtggtggtgccgtttaccatgatccgggaaacctgaatcttacatttatagagaccggccagattatgcagaccgataaatataccatccagatcatgaattttctcaagacattgggagtacatgtcgaggtggatgaacggaaaggattaactatcggaggatttaaaatatcgggtagcgcacagagtatccataagaatcggtatatgcaccatgctaccttattgttttccaccgatctggataggctcgtcacctccttgaaaagtacatcccgtcaagcaccagagaaaacaggaggtaaacgatcgacattcgttaaatctgtacggagtccggtcacgaatatcagcgcccatcttccggcttctatctccatccagcattttaagaaagcgcttctttactatttcacgatcaataatcccggcattcaagattattatttcacgcaagcagacttggaagccatctatcggcttaaagagcagaaatatgctacagccagctggaactttaacacttatacactataatacagaaacttaccttcttgatctttgttcttattatataccgtttgtagagacggggcacgccccgtctcccactatataacagtaattaaaaaatcaaaatatggctacatttgagataaagatgcctaagttgggcgaaagtattacagaaggaaccatcatctcatggtcggtaaaggtaggtgataccgtagaggaagatgatgtccttttcgaagtaagcacagcgaaagtaagcgctgagattccatcccccgttgagggaaaagtaaaacaacttctttttaatgagggagacaccgtagcggtcggtacagtcgtagcgatccttgagatcgaaggtgaaggagaggataacggagctcagccggaaacctcggaggctactcaaccgaaagaaaaagtccccgctcccgcctcagaggaattatcaaagaattcccaagaggaagatcgttggtattctcccgtcgtattgcaattagcgaaagctgccggtgtgtcgcaagatgaactggatcatattccgggtaccggatatctgggacgtctcagtaagaaagatattcaaacgtatatcgatcacaaaaataaaggtacggaaatgccgaagccgaaacaggctcctgtttcttccatgcagcaaacggctacgagcacgccaacaattacggtagcgccgccgaccgctccttccatgcctatgacagcggccactccatccgctccactcgcccaaggagacgaggtgagagaaatggatcgtgtacgtaagatcattgcggaccatatggtattatcgaaaaaagtatctccgcatgtgacgtcggttatcgaggtagacgtgacccgactggttaactggcgtaaaaaagtgaaggatcaattcttcaagcaagaaggcatcaacctaacttatatgccggctattaccgaagcgaccgccaaagcgttgaaagcctatccattagtaaattcatccgtggacggttacaatatcatcctaaagaagcctattaatataggtatagcggtttccttaaacgacggaaatttaattgtcccggttatacacgatgccgataagctgaacctaagtggcctcgcctcacaaatagataccttggcggctaaagcccgtgagaataagctcgccccagatagcatccaaggcggaacgttcacgattacgaatttcggaaccttcaagagtctgttcggcaccccgatcatcaatcagcctcaagtagcgatcctagccgtcggttatatcgagaagaagcctgcggtagtagagacgcccgagggagatacgatcgctatccgtcacaagatgtacctctcactctcctacgatcatcgtatcgtggacggagctttggcgggagcctttttacgttccatcgccgacgaactagagaattggaacgcttaatacattatatataatagaacaacatgaaaaagtatgatataaaaacaacagataaggagactctcaggaaatggttttaccttatgacgctcggaagggcgatcgatgagaaggctccctcctatttattgcaatctctcggctggtcttatcatgccccgtatgccgggcacgacgggatacaactcgccatgggacaagtattcgataaggacacggactttctcttcccctattaccgggatatgttgacggttctctcggcgggaatgaccgccgaggagatcatcctgaacggtatctccaaggcgaccgatctgaccagtggcggccgccacatgtctaaccacttctctaagatggaatggcatatcgagaacgtttcttccgctacggcgactcacgatctccatgccgccggcgtggcacgggcgatggtttactatggacagaaaggcgtagcgattacctcgcacggtgaatcggccgcttccgaaggctatgtgtatgaggcaatcaatggcgccagcaatgagcgactgccggttatctttgtcttccaagacaatggatatggtatctctgtccccaaaaaggaccagacggccaatcgtaaagttgccgataacttctctggcttcaagaatttacgtattatccattgcaatggaaaagacgtgttcgattccatgaatgccatgaccgaggccaaagagtatgcgatcgccaaccggactcccgtaatcgttcaggccaattgcgtacggataggctcccactcaaactccgataaacataccttgtatcgtgatgagaacgagcttacctatgtaaaatccgccgatcctttatacaaattccatcgcatgctgattcgttacggacgtttcaccgaggaagaattgaaagagatcgcggatctagcggctaaagacctgaaagccgccaatcggaaagcgatggccgcccccgatcccgatccgtctaccgtcaaggattacgtcctcccggaaccttatcaacctcaaaaatacaaagaaggtgttcaaaacgaggaaggagagaaagaaacgctagttacggcgatcaacaagacgttgaaagcggagttccggcacaacccggatacgtttatctggggacaggatgtagccaataaagaaaagggtggcgtattcaacatcacgaaaggcatgcagcaagaattcggtatcgagcgagtcttcaacgcccctatcgccgaggattatatcgtagggacagcgaacggtatgtgccgctttgacccgaagatccatgtagtgatcgagggcgcggaattcgccgattacttctggccggccgtcgagcaatacgtggaatgtacgcatgagtattggcgcagcaacgggcaatttaccccaaacatcactttgcgcctagcctccggaggctatatcggaggaggactttatcattcccagaccatcgagggcgcattgacctcactgcccggtgcccggattgtttatccctctttcgcggatgatgccgccgggctgttgcggacgagcatgcgttctaaaggctttacgctctatctggaaccgaaagcgctctacaacgcggtagaagcctccacctttgtccccgaggatttcgaggttccgttcgggaaagcccgcatacgccgtccgggaaaagatctgacaatcatcacttatggcaatacgacccatctttgcctcaacgtagccgagcttctttacaaagaaaaaggctgggaactggaggttatcgatcttcgtaccttgataccattggataaagaggcgatcttcaactcggtgaagaaaaccagtaaagtattgatcgtacatgaggacaaggtcttctctggcttcggagcggaaattgccggcatcatcggctcggaactattccagtacttggatgctccgatccaacgggtaggttccctattcactccggttggtttccatccggtcttggaacgggccatcctccccaacgaggagaccatctatcatgcggcaaaagaactgctgctttattagatccacattcgttaaatctttaaaagtatcacaatgaaaacaggattattttacggaacgggcacagagaaaacaacctttgtcgccaataaaataagaaaagctttcggggaggatcagatcgatatcatccctattgaaagcgcatggaaaagagatttcgaggcttacgaccatataatcgcaggaacctctacttggttcgatggcgaacttcccacctattgggacgagatcatcccggaactggtcactttagaccttaaaaataagaaggtcgctattttcggtcttggagatcaaacgaattatccggataatttcgccgatggagtcggcatattggcggacgctttcacctcctgtggagcgactttagtaggcgagacctcttcggatgattatttctttaatgcctccaaagccttgaaaaatggcaaactactaggcttagtcctcgatttggaaaaccaaccggatcaaaccgacaaacgaatcgagcgatgggtgaagcaattgaaggaggcgtttggataaagaagaatgcatcttaaactcgtaaacgagaactaaacagaaagcgtaacgaatcactccacgggtttgttacgccttcattctatacacctgtctttcatacacatactgtgccaacatctgccatcgccttggcacagctgtgccacgctgatggcatacccgtgccatagtgatggcaagcccgtgccacgccgatggcaaagctgtgccacctagatggcaaacatactttattagcaagacgctaattagttaaacatttgactaatccgagaaaaaacgctatcttcgcgcccagcaagtttaaaagaattataagtaatggtagaaggtaaagaattccgggaacttatgttacaagttgtccgcacacgcatggcatttcgtcggtctatgcaacgaacgctgaaaaagaacaacgccggtataacatttgagatgcttcaaatcttgagttgcctatggcacgaacaaggtatcacccaacaggtcttggcagagagaacggcaaaggataaggcttgtctgacaaacctaatgaacaatttagagaagaaaggctacgtccatcggaaagaagatcccgaggaccggaggaacaaactggttttcctaaccccggaaggagaagaattcaaaaagcaaattcgcccgatccttgatcaggtttatgtacatgcggagcatattatcggaatagagaacgtagaaaccatgttatccgaattaaaagcagtacataatgtccttgagaatatataaaaagcacgtattgagcctcttttgtatgacggtcgctacatttccggcaatcgcccaaaccgattcgctcttcttgaccatcgaccagcttttcgagagaggcgtacggcatagtctgcagatccaagcagacgtcttaaaagaatcgatagcgcaagagagaacccatacggcacgttccgcacaattgccagacctgcaaatcggcttgaaaggtggatatgtagggcaaccgatcctctttgagcaaggactcgcccatccgactcgcccggaagcgcccgattggtcccagaactatgccatcgaccttacccaaccgatataccaaggcggtaaaatccggtattccatccggaaagcggatctggagaaagaagtcgcctctttacaaacgctcacagaccaaagtgagatcaagctcggtctattaaatcaatacatcggtcttttcagcctgtttaaacaacgtgaggtgctttcccgtaatatcgaggaatcggaacgccgcctgcaagatatccggcgtatgaaaaaagagggactgataaccaataacgacgtattaagaagcgagatgcaattaaccaacgaccgcctatccttgcaagaaacggataatagcctcatactggtatcacagcaattggatatcctgatcggtctcgatgagaatctgttgctcaagccagacaccacgttactggaccaaaccgtatctttagaaacttacgaagattatgtagcccaagcctattccaatgatccggcgatacgtctactccggaaacaaacagagttagcccaaaacgatatacgtttgactaaagcctcatcgctacccagcctatcgctatatgcgtcgaacacattggcacgtccagtctcccgaacattagcggatatgtacaataacaactggaacataggtctgtcgctctcctaccctttatcctctttatataaaaacaaccataagataaaggaaagcaaatggatggtctcgttacataaaaacgaggaggaacagaaaaaacagaaaatccgtatagaagtgcgcaccgcgttcttacgtcataaggaagctctacaagaagtggaagccttgaagttatccgtacggcaagctcaagagaactacaggatcatgcaaaaccggtatttaaaccaattggcgatcctaaccgacttactcgacgcgaactcggttctcctcaacgcggagctacagctcacgaatacccgtacccacgtgatttacacttactatcaactacagaaggcttgcggccgtctctaaaaagaaacaacgactatggcaaacgaattaaaagagaaacatcaaagactaaagaaagtaaggacacggaatatagtattaaactccatatgtatccttttagccggttccggcatttggtggacagccaattatttctggcgttacatcaattatgaggtgacaaacgatgcctttgtggaccaatatatcgccccactaaatatacgtgcctccggctacataaaagaggtccgtttcaaggaacaccagtacgttcaccaaggggacacacttctcatattggacgatcgggaatatcggatcaaggtaaaagaggcagaggccgcgttgatcgacgcccaaggatcacaagacgtacttcgttccggtatcgagacctcccatacgaacatcgccgtacaagacgccaacatcgccgaggctaaagccaagctttggcaactggaacaggattatcaccgatttgagcggctgctgaaagaagaatcgatccccgagcaacaatacgagcaatccaaggccgctttcgaggcggcgcaagcccgatatcaggcgttggtggaacaaaagaaagccgctttctcccaattcaccgaaaccagcaagaagacaataggagccgaggcggcgatcttacgaaaagaagcggatctggatttagcgaggttaaacctttcctataccgttataaccgccccttacgacggtcatgtaggcagacggaccttagagcccggacaatacgtgcaagccggacaaacgatatcctacctcgtacgagataaagacaaatggatcacggccaattacaaggagacccagatcccccacatctatatcgggcagaaagtacgtatcaaggtagacgcattgccgggaaagatattcaacggggaggtaaccgcaatctccgacgccacaggctccaaatactcattggtcccgaccgacaattccgccggaaacttcgtcaaggtacaacaacgtatcccggtacggatagatttggaaaatctatcgcaagaagatacgcaatatttaagagcaggcatgatggttgaaacagaagccttacgcaaatgatcacgatgaaagagcttggggcaccgatccgccaatgggtgccggactggttaggattgatttgcatcttcatcgttattcttccggttacgatgctaaacggttcgtacaccggcagtatgctggaggtatcaaacacgctaggcacgaacaccgaggatataaccatgggatattacgcggcagcggcgggaatggcggtatcctatccgattattccgaagatattagaagccttctccatcaaattcttattgttggcggatttagtcgcccagttcttcctaagctggatctgtgcccgctcccagaacgccgacatattgatcgtctgtagtttcgcgatcggtttcctgaaagggtttctcatgctgtggtttatccggtacgcacaaaagatattcagccctaaaaatatacgtagccaattctattcctacttctatccttttgttttcggagggggacaagcatccatgcttgttaccgcacagttagcctaccattacgactggaaatatatgtattacttcatgatgctaatgattttattggccatagtaatggtaatcatctgcttccgccataaccggccgatcaagtccatccccttggccgatctacacatccgggaaatgttcatcatatccaccggattgttaatgcttatgtatgtcattaattacgggaaagtactcgactggatggcatcccccaagatttgcctttatatcatgatcgccccgatattgatcgctttatttatttggtatcaatatcattcggaacgtccgtacgtgaatctggcgcctttataccagccgaaagctattatcggttatttctatatgatgcttgtcatgtttttcagtacttctactaccttgttgactagttacctgactagtatcttaaaggtagacagtacccatacctattccctttatacttatttgcttccgggatatgtcttgggggcgttcatctgtttttggtggttccggtggcaacgttggcggtttcgtttcttgatagcgggaggaatgagttgtttcgtcctgttcttcgggagcctttatttcgggatctcaccggatagcagatacgagatgctctactttcctatattcctcaggggattgggcatgatgattctaatcatagctttcgccttatttgccgtggaagatttaaatcctaaatatttattgtcaaacgctttctttctcatcattttccgttcagtattatcccccatcatggcgacttctttttacagtaatatactatatcgcttggaacaaaaatatatgtattccttatcagaaaccgttacgctggccgatcctctagccgcctcacgctataaccaagcgcttggcaatgccttgacccaagggcatccctacgacgaggcagcgcaaatggctaccagtacactctataatacgttacagcaacaaagcttattattggcgttaaaagagatactggggtatttattagtcatctccttattcatagcgatcgtatcccgctttatcccattccataaaaccatccgtgttacattcgccaagacaggagatgatatggtttgatcaaactatgcccggctgcaaatctatcagccggcatctgcctttttgtcatttatagtttatccgaaacactttggcattcgttttgtataggaataggcggatcttgagaatgatcaagataggaatacgcacaaaataacaataaaataataagatattcagactatgagcagtaaacaaggtaacatcggagtaacatcggaaaacatctttccgattatcaagaagttcttatacagtgatcacgaaatcttccttcgtgaacttgtttccaatgcggtagacgctacccaaaagttaaaaacgctttcttccgtaggcgagtttaaaggcgaactcggcgatttgaccgtacaggttaagttcgatgacaaaacgatcacgatctctgaccggggtatcggtatgacagccgaggagatcgataagtacatcaaccagatcgctttctccggcgccgaggagttcgttgagaaatacaagaacgacgccgcttctatcatcggtcacttcggtcttggtttctactcctctttcatggtttccaagaaagtagagatcgtgacgaaatcatacaaagaaggcgctgttcccatgaaatggagctgcgacggtacgccggaatactctttggaggaaacgacgaaagaggatcgcggtaccgatatcatcctgtatatcgacgacgagaacaaggatttcttgaacaaggataagatcaatggcttattgacaaaatactgccgtttcttaccggttcctatcgcgttcggcaagaagcaagagtggaaggatggcaaatatgtagatacggacgaagataacgtaatcaacgacaccaaaccggcgtgggttcgcaaaccggccgatatgaccgacgaggattacaagaagttctatcgagacttatatcctatgacggatgagccgttgttctggattcacttgaacgtagactatccgttcaacttgaccggtatcttatatttccctcgcatcaagagcaatatcgacttgcatcgtaacaagatccagttatattgcaaccaagtattcgttacggattccgtagagggtatcgttcctgagttcttgacattattgcatggtgtgttggattcgccggatatcccgttgaacgtatcccgttcctatttgcaaagcgatcagaacgtgaagaagatctccaaccacatcaccaaaaaggtggcagaccgcttggaagagatcttcaagaacgaccgtccgcagttcgaggagaaatgggatagcttgaaactattcatccaatatggtatgttgactgatgagaagttctacgaccgcgcggttaagttcgccttattcaaggacgtcgagggcaaatacttcactttcgaggaatacaagaacttaatcaaggacaaccagacagacaaagagggtaacttaatctatctgtataccaccaataaagacgagcaatacagctatatacaagccgcaaaggacaaaggttacagcgtcttggatatggacggacaattggatgtacacttgatcggacaattggagcagaaattcgagaagagccgcttcgttcgtgtggatagcgatacgatcgataacttgatccgcaaggaagatgcgaacaaggttactttgagcgaggagcagaaaacggccatgcaggaagtattcaagagccagatgccgaaattgaacaagaccgagttctacgtaacattcgaggcattgggcgaaaacgcgaaccctgtcatgttgacacaaagcgagtatatgcgaagaatgcgtgagatgtccgctatgcaaccgggtatgtctttctatggcgagatgccggatagcttcaacttcgtattgaatacggatcatccgttgatcaagaaagtattaactgaagaggagcaagcttgcgacgagaagttaaaaccgatccttggcgatatcaaaggatgggaggctcgtcaagccgacttacgtgaggctcaaagcaaaaagaaagaagatgagatcacggcgcaagagaaagaggatatgaccaacaccgaccataagctggatgagcttcgtgagcaacgcaaccaagttctcgccgagtacgccggcacgaacaagacagttagtcagttgatcgaccttgccctgctaggaaacggtatgttgaaaggagaggccctaagccaattcatcaaacgtagcgtagaactgatcggataaaccaatcctcacatatataaaaaccgttccttctcgggggaacggtttttttagtttcagctcacgacatcctcgaccactttccgtaacctatccaagctcatctcgccggattgtctccacaaagcctcccctttccgtagcaggataaaagtaggaaccgattccaccgtatacaaatcggcaagagcgctctcctcctcgatattgatttgtactacttctaattttcctttctccaattccttgaactccttcacgatcggcatcattctctggcaatgaggacaccaatccgcataaaactcagccatgaccaaagcaccggtctccataacggttttattccgttcttccctgtttaaatctttttctttcataacatcatctgttttaattgtattgataactcaacaatacgaaaaaacaaaatgtttatgtttctaaagaaatacttcttacatttggagaagaaaaacagattgggttcatatgagaaaaataaccgttatcatagccttattccttgcagccattcaaattgtttccgcccagaaagtagggttggtactcagtggcggcggtgccaaaggagcggcacatatcggagtgatcaaggcgctggaagaaaataatataccgatcgattacattaccggtacctccatcggggcgattatcggtagtttatacgccatggggtattcccccgaggagatgctggagctaatgctttccaaggagttctcctattggcaaacaggtacggtggaggagcaatatacctattatttcaaggagccttacccgaccccggaattcgcgcatttctccatcgatatgtccgattccctacagatcaaggctagcttcttaccgcaaagcttgatcaatcccatacagatgaatcaggcgttcatggccttgttctcgcaggcgacggcaaaggcgggatggaatttcgacaacctgtttgtccctttccgttgcgtggcctcggatatatataccaaaaagccgatcatctttaagaatggggatctgggagacgccgtacgtgcctccatgactttcccgtttttcttccagcccatatggaaagacagtattcctttatttgatggaggtatctacgataatttcccggtaggcccgatgaaagatgcgttccacccggatttcattttcggatcgacggtatcgggagggaataaaaagccttcggagaatccttataaccagatcgagaccatgatcatgcaaaagaccgactatgaggtaccggaagaagatggcatgatgattaaattcagtttccccaccgtctccttattggatttccagaaaggtaaggagcttatggacatcgggtataaacgtaccctttccatgatcgactccatcaagcaacgggttccccgggaagtgcctttaaatgaggttaccgaaagaaggaaagcctataaagagaaccttcccccgctgatcttccgcaatatttacgtgacgggcgtatccgaggcccagcgtaaatacatagaggcccaattacacagggatatcaataacgagttctccatggaagagttcaagcgggcttatttcaagatgctgacctattccaagattagggaaatcatgccgcatgccgtttataaccggaaagagaagaaattcgatctttacctggacgtgaagatgaaagaagagatcacggttggcttcggtggaaacgtatcgtctcatcaagcgaatcaattatacctaggattggggtatcaatatctgggacggttcgccgccgacgtaaactcgaactttcaagtgggtaactcctttagtggtgtcatgttgagtggccggatgtacctgcaaacgcaaatccccacttatttaaattggcaaggagtcttctcggacaagaaatacacggaaagccaatccctcttttatgaggatatagtgcccgccatgattaagcagaaagaactgtacatgaaactaaaattaggcttccccttcctcaaccacgcgaaagcggagatcgggttcgcctacggacggttgaacgatttctatttgcagagcaccacgatacctttcccgaacgcctctttcgaccatagctggtacgatttattcagcggttcgttaagtatcgagcaaaactcactcaacgccaaacaatacccgataagcggaaaacagcaattcctaatcgcccaatacgtaaccggtacggagaagtacactccatcccccacttccgccacgacggaagccccgattggtcgcaaagtgcatagctggctgcaactgaaagggcgctggaaccaataccagacgctgagcaaccgtttcaacttaggttatttggcggaaatggtcatatccagcaagaacctcatgaataactatacggctagcgtattacaggccccggcgtttaccccgacaccccatagcgagattgtattcaacgaggcgttccgggcgaaccaatatgtggctttcgggctttccccgatcttgaagttaagcaagcttctgcacttccggttggatatgtatggcttcgctccgctctatgaaatacaaaagacggtgccggaaaacaacccgtatgtcggaatcccgcattatggtaagtttttgcactcgtttaattatatgggtgaagcggcggtcgtattgcaattgccattcttatgtattagtctgtacgccaacggatacagttatccgaaggagaatttcaactttggcttaaacattggttatctgatcttcaatccaaaaatgttagattaaattcgcaaaaaagtagtcgaaacgtttgcatatttaaaacaaaaacgtacctttgcactcgcaatcacgaaacaatggccgcgtagctcaactgaatagagtagctgactacggatcagccggttacaggtttgaatcctgtcgcggtcaccattcgaagatagcaatagaatatatctaggctccttagctcaactgaatagagcatctgactacggatcagaaggttaaaggtttgaatcctttaggagtcacttgaatattcaaattcatttacagattggctcgctagctcaactgaatagagcatctgactacggatcagaaggttataggtttgaatcctatgcgagtcacttgagaatccttctcccgtcgatcttcttatcaaaggttacgagagaaggatttttcattttcccttaccgctctcctgctttcctcaatatatatacccgatggtttcccctgcccgatatcgttattccactttccgggtcagcgccaaggcggcgcaattccaaggaagcggtcgtacgcttcaagcccgtgataaacatataatcttgcaagcacatgcaaggatgctccgccaaaaagcccaaagccctctcccgccgctcctcctcgctgaaaggggatttccgtactcggacgataccgccccgactcaaatcgcaacgcagcttggtttcctgcaccagttccttatccgcccggaagccgacaccgttcacctccagactacgagcgttccgcttcggatcatccccatccaaggtatcgctctccttatctttcaccactcccaacttaggcgtgaacgtaccgatcccttcaagcgtaacagaatgcccatctgccatgcaataagccagacgctccgccaccatcgtcatcacctgcaacacgttgcccttgctcagtcccgagccgggataggtgatctgctccacgaaatgctccatatccacgttttgctctatcttcatccgatagtacactcgtttctcgcccgtcccgtcaagatcgttcatctcttgcttgatgtatctcgccataatcgctatatataatgttgttttactagtaagaaaaccattttcccctatacacaaagataatcacatatgtgcagagaaaacgcatgaattaaaacgcataaatccaccgtgttattaaatcatataggcaatcttcattccatgcggccatcatcctctttgaatgtgatatccagttgccaatgcaaaccgttctctatcccccagtgctttcttttgacccgcatgattttctcgggatcgttctccaatgaggatatgaagtaatgcgtctccacggcactttcccctgtcgcctcgtctacacgttccgtgcggatgaggccgtaggatctcaagttctcccaatccttgtatatttttcctaaggaatgtagtgaggagcatacacggcattcacgaaggaagacaaacccatgcccgttctccccctccttgtggactttatacacctcattgggaagtgggatacgttcgaagtctctcatgttaccggcgatggtttcccacaatgtggcttggttctttttaacctccagcagataaccggctctcttcttggctattctcgagacgatatctttttgggttcccatggcgtcgatggtcaccacgtctccctccgagatatccaaatcgtccaagagccttgggatggcaactatctcgttctccttcttatccacccgctcttgtcccaacgagaggcagtcgtcaacagaaaacgcgctgacgatgtgaagcttatcattggagcgctcttcctgtgtcatgaagaaaccatcctcatcccgtctccgtctttcattcatggccttttttatggtcttcccgtctatggctatctggcggaacggcttcttttccctctcctcggcgattccctcctccactaatccctcttcctttgaggtggcaagattttctcgcatgttcaaggcccacgcacggtaacgccgctcaagggcgttgggacagaccaggcaaaagaaacgcctgagcgtgtcatgcgacggggccttttggatgtcaggaaagaactttcgaatgaaatcgatacgttccgccgagaagtccgcaacctcattccaactctggcagttggcaaacaccccgattaatgccgacatcatgatcactcctgcccggtgtaccaccttggattcctgccgtgagtctatctctcccagagcattgtacatgctttcaagatgtctttccaactcgtcgtttatcaaaaagtctttccccgctttatccatgtatgtctttttgaaagcaaagataatggaggtaaacgagatatgctttcaaaaagagcttaaacaactatttatttatccatcgtatattttaattggcattcatgcgttttctctgcagtatgcgaacaagaatccataggctatcgagcaagaattcatatagataataccggatttattataaggaaaaagatattccgcgtacatttgtgatataatatccacagtttgtatcgaacacaaaattaccacccaatgagatttcgggagcaagcagttttggtatgtctccaaagtttatcccttgcgaacgtccaaacataaaccacctgtcattatcaaacctcccttattatggaacagcatttagatacaaataaagtgtgtttcggctgattcctaatttttttgcgatttggctcttgcttaatccctcgcccaacatctctgtaatagttctttccctgtcaacttgttccgtttattcttgctcccctttattctcccgatatgttttccttctgctttcaatcgggccaaagcctcttttgtccgttgcgaaatcaagttacgctcaatctctgccgacaaaccgaaggcaaaagcaagcaccttgctttgaatgtcatcaccaaggcggtaattatcttttatagtccatacacggcattctttggtcatacagatgttcaggatttccattatcatgaaaaggttacgccccaagcgggatagttcggcgcagatgattaagtcatctttcttcacttggtttaaaagcttacccaactcacgtttgttgtacgattttgtttcactaatggtctcctctatccaaccatcaattttcagattttcccgctcacaaaacttattgatctcgaaacgttgattttctaccgtttgcttgtcactgcttactctaatgtacccgtatatcatgctcataagtcgtttttcacgcatgatactattttatttcgtacatttggcctgatttcaagaaatataatcaaaacatataaaataatggaacaagaaatccaactgaacaagcacaacaagcaaaagtatccgcccatgcatacggcagattttaacccagccttaaacgatatcatcatttaccaaacggaagatggggaaatcaagctggatgtaaagatggagaaggaaaccgtttggttgacacaagcgcagatgggtgagttgttccaaaaagacaggactgtcattggccgacatattaataatatatataaagaaggagaattagaaaaacatatcacatgtgcaaaatttgcacacatgggttctgagggtgaccaaaagtatgaaacaacactttacaatcttgatgtcatcatatctgttggttatcgtgtaaaatccaaacgtggtatccaattccgtatctgggccaacaaaatattgaaagactatcttatcaaggggtatgccatcaaccagaagataaaactagaacattatcaagagctaaaagatatcgttcgtatactcggtaatatgctcaagaaccaagaacagttgacctccgatcagtccaaaggcttattagccgtcgtgaccgattatgtctatgcccttgatactttggataagtatgattatcagcaactgacgatagaggagacaatcaaaggagaccgtttccaagcgacctacgagaatgcgatggaagccattcgaagcctaaaagataaattcggagaaagcgaacttttcgcacatgagaaagacatcatggtaaaagtagtagtaaatttaatcaatcaaaataattaatatggaacaagaaatccaattaaacgagcacaacaagcaagagtatcctcctatgcacacggcggaacatatcttaaaccagacaatggtacggatgttcgggtgtcccagatccaagaacgcgcacatagagaggaagaagtctaaatgcgattatctattggcggaagagcccagtgcggaggtcatggccgaggttgagaagaagataaacgaggtgatcgaccggcacctgcccgtaaccatcgagttcatgccgaaagaagaggccggcggtatcgtggatttaagtaaattgcccgatgatgccagcgatacattacgtatcgtacgcataggcgattacgatgcctgcgcatgtatcggatcgcacgtggcgaatacatccgagatcggacatttcaagctattgaattacgactatgccgacgggagattacggctacgtttcaaattggtataaaatttaaagcaagcgcaaacagccaaatgaaatattttgtgtaagtttgcaagcgattaaaagaacattttaatacagacattaaatacaatagttatgcaaacaattgacaatttcaattttgccggcaaaaaggcatttgtaagagttgactttaacgttccattggacgaaaacttcaacatcaccgacgacactcgtatgcgtgccgctcttcctacattaaagaagatcttagcggatggtggtagcgtaattatcggttctcacctaggtcgtccgaaaggcgctactgataagttctccttaaagcacatattgaagcacctttctgagttgttaggcgtagatgttcagtttgcaaacgactgtattggcgaagaagccggcgctaaggctgccgctttgcaaccgggcgaagctttgttgcttgagaaccttcgtttctacgctgaggaagaaggcaaaccaagaggtttggctgaagacgcttccgacgaggagaagaaggctgccaagaaagccgttaaagaaagccagaaagagttcacgaagagattggcttcttacgctgactgctatgtaaacgacgcgttcggtaccgctcaccgtgctcacgcttctacggctttgatcgctgactacttcgatacggacaacaagatgttcggttatttgatggagaaggaagtgaaggctgtcgataaggttatgaacgacatccaacgtccgttcaccgctatcatgggtggttctaaggtttcctctaagatcgagatcatcgagaacttgttgaacaaggtagacaacttgatcatcacgggtggtatgacttatactttcacgaaagcgcaaggcggtaagatcggtaagtctatttgcgaggacgataagttggatcttgctcttgatttgatcaagaaagcgaaagaaaaaggcgtaaacttggtattggctgttgacgctaagatcgctgacgatttcagcaacgacgctaagactgatttcgctccggtagatcagattcctgatggttgggaaggtcttgacataggtccgaagaccgaggctatctacgctgacgttatcaagaactctaagacgatcctttggaacggtcctacgggtgtatttgagttcgagaactttacgcacggatctcgtacggttggcgaggctatcgttgaggctacgaaaaacggcgctttctctttagtaggtggtggcgactctgttgcttgcgttaacaaattcggtttggctaacggcgtatcttacgtttctacaggtggtggcgctcttcttgaggctatcgaaggtaaggttcttccgggtatcgctgctgtaaaaggcgaggcttacaaataatcagataagtaagtgatttaataaaaaatcccccgggacgctcggtattcatcgagatgtcccgggggattttctttgatttagttccgtattaatcttgtttcaagatcaaggcggaagaggcgcttacggtagttttaccctgtacggaacctttaccgtccagataaatccgaccatccttacaaaccggaacccatgttccttccggcagagaaaccgttaccgccttccggttcccgttaaagataaccataatcttcttccaactatccccgttcgcatgctcccctaaggtatacgctacgacaccgggctggttcacttcttggaattgaagggcctccctcactccctcggccgtggcgatacggaaagccgggtgcgacttacgaagggcgatcaaatccttgtaatagttgaaaacatccttgttttttgcctttaaagaccagtcgatctcattgattgaatcgggcgattgatagctgttatgtacgcccttcttatcgtgcagcaactcctctcctgcccgcatgaagggtactccttgcgaggtgaagatgatggtctgggccaacttgccgaatcgtatcaactcatccggggtagcgtctttcggagccgagagcttcaacttatccatcaaacaaagatcatcgtggcaagagacatagttgatcacttgcgtaggcttgttcgcataaggcgctttgcaatataatatttggttatagtcgatttgcggatggcggatagcgcctacaataccgaacttaatagactcctcgttaccttccggctttccggaggcgaaaccggcctgtgtagtctcgaacacgcttccttttaaagcatcccgcaggtcatcgctaaatacggccacgtcattcagtttcggggcgtttaccttgatcgccctctggtcctccggtagcggggaatcgctggcggtccaaccctcgccgtatacgaagatggaaggatctagtttagctaactcggcttttacctcgttcatggtctctacgtcatggatgcccatcaagtcgaaacggaaaccatccacatggtattcctcggcccaatatttcacggactccacgatatagcggcgtaccatcgcccgctccgaagcggtctcattaccacagccggaggcatccgaatagcttccgtccggtttatgacggtagaagtaaccggggacggtcaagctgaaattcgacccgtcacccacaaaggtatgattgtaaaccacgtccatgatcacacggataccattccggtgcaatccccgcaccatctccttgaactcacggatacgagcctcgggattgtaaggatcggtggaatagctcccctcgggggcgttatagttcttgggatcatacccccaattgtacacattatcttgcaagcgagtctcgtccaccgagccataatcataggaaggaaggatatggacatgggtaacgcccaactccttcagatgatccacgccggtagccacgccgcccggccctttcgtgccctcctccgccaaggcgagaaacttacctttatgcgtcacgccggagttcgcggcgatcgagaaatcccgatgatgcatctcgtagatgataatatcggagaagcttttcaactcgggagatttatccgcctcccagccctccggatcggtagccgcccaatcgatcacggccgcacggtttccattcaccccgacggctttcgcccagataccgggagtctcatccagccatttatcgccgatacggatctggaaggtatagaaggagcctttcagatcctcgctcacggagatacgccacgtacccttgtccgaggatttcatcggcaaccggcggacaggctcccctccttcaccggaggcgtaaagattcaagcggacttcttccgccgtcggggcccaaagggtgaacacggatttcgtgggagaatagaacaactccagatcgtctccctcataggaagggtattcatcaaaggatttgtattctttcggcgagttgcagctaagcaacagcgacaggtatatagataccggaactaagtgtctcgtcatggctgattcagtaatttgttttcaatcacaaagatagaagattcgaaccggattcgccaacgaaacagaaaagaagaggcgaaaaatctaccgcaaacgttttcgcctctttcgctcattcatgctatattagaacggaacctcgttactgctaccttgactcaagaagtcagctcccgccgatgggatcgggggcatcgggtctccaccgttcatggttgaggagaattcccttaccgctatatcttcctctacgttcataaacttggcgaactcgctcttaaagcgcagccggacatcccccacggcaccgttacgatgcttggcgataatgatctcggcgagaccgatcagggaatttccccgctcgtcttccgtaatcttataatattcgggacggtggatgaaacataccatatcggcatcctgctcgatagctccggactcacgcaagtcggctagctgcggacgcttaccttccacgccttgacgggcttccacaccacggttcaactgcgacaaggcgataatcgggatattcaactccttcgccaatcccttcaacgagcgggagatcgtactcacctcctgctcacggctaccgaagttcataccgctggcgttcatcaactgaaggtagtcgataatgatacatttaatgccatgctcacgcaccagacgacgggctttcgtccgcagctcgaagacggacaagctcggggtatcgtccacgaagatcggggcgtcgtaaagctccttgatcttaaaatccagctgttcccactcgtagctctccaagcgtccgctcttgatcttctcgcccggtatctcgcagacattcacgatcagacggtttaccaactgcacgttactcatctcgagcgagaacagggcgacaggcgtattgaaattcaccgccatattcttcgccatggaaaggacgaaggccgtcttacccatggccggacgggcggcgataatgataaggtctgaattctgccaaccggaagtcatcttatccaacccctcgaagcccgtacgcaatccgctcagaccttccttctggagagccgccttttgcaacatctccatagcgtccttgatgacggggttgatctgggtgacatccttctttacgttacgttgcgagatctcgaacaacttgccctccgcctcttgcatcaggtcctctacatcgagcgtctcatcaaatgcctttccttggatcatcgccgtgaaagagatcaactccctcgccagatatttctgggcgatgatacgggcgtgatactcgatatgggcgctgctggccaccttgctggtaagttgagagatatagaacggtccgcctacatcctccaattctccccgtttcttcaattgctccgttacggtaagcatatccacgggacgctggctcaacgccaagtctacgatagcggcataaatcttctcatgcgctttctcatagaaacactccggcttcaagatctcgctgacgatcgagtacgcgtctttctccagcatcaacgcacccaacacagcctcctctaactcacgggcctgtggctgaagacgccccatatcggggagcatctccacaggctttttccttcctcttcctgtatttcttgttccttctgccatcattctttctatttggggagtcaaaggtaatatcttttacccatttctgaaaaagattctttatatttaggaattaaaacctgtcgaatcatgaaagcgtattttatcggattagttatcatgggaggttgcctattatacggctgccataccaaacaaaagaaagaggaaaacagtagcgactactcagccgactcccaatccatagcacggcaagataccctaccgttaccaactgatacccatgccgcatcttcagtttccacggaaggatggaccgccaagcagatacgggacagcatagaatcgttcttcggcaaggaatacgatacccttcccccgcatctacggaagatccgtagaaacatgacctccctctggaacacggacgactccgtcttcctacagcttatcatagcggagaaggagtatgtggaggctttcaagacttacgtattcaattcacccctcatccggatcggcggaggcccttacgaccggccacccgaggaagctatcagcatggacaccacccacttctccatgcgagtaagaccgaacgtctacccaaccaacatcgagcggatcgagatcgctatcaccaaccataccgacctggaagggatgggaggcgaagagtatttcatcgagcgtttcgacgggagggcatggaaaggaatcccgcaacccaccgccttcgtcgctctcggctatccgatctttcctaacgagacaagagacgatttctcggccaccttgctgcctgagctcaaggaaaaccctccgggattgtaccgggtgcgcaagaccgtcatcaccggacagggcgccggcatcgtccattatcctttggccgccacgttctacctatccgataacccggaagattatgaggaatacacacgtttcgccagccggctccacgagcctcgccccatggccgagttcaagggaggaagagaagccatggtccggtcagcatagataccgggctcttcttctacttcaacgaagaggggaaatgcgggattgaatagatggccagtactgcctaagaagtattggagtacttcttaggcagtactcgggtacttccatgaaagtactccagtactattaccagaagtatcgcaatactctcagagaagtaagcctatgctaacgtaaactggcaacaatattgctgtcagcatacagcgacataactttacttacgtaaaaaagtattatctttgcacccgtaaaaagtaattttcaaattatggacgacagtatcccgctagaaacagaacagagtatgaactaacgaggcggagggtttcattgatcctctgctcggattaaacacgaaaggaggcaataatgagacaatttctttattgtgaggccggttatgtggagaagaaccaatggcttcctaacagttgggtaaacgtagagtgcccaactcccgaagatcttcaattcttgatggatcgatttaacgtacccgaatcattcttgagcgatatagccgatacggacgagcgtccccgtatcgagtacgaggggaattggttgcttaccatcttacgtatcccgttgcagaaccaagatcatgacatcccgttcaatacggtgccgatcggtatcatcacgaacaatgagatcatcgtaagcgtatgttaccataagacggacttgatccccgatttcatccgctatacccaacggaaggaactccagattaaaaacaagtatgagttgatcctccggctgatccactcatcggccgtatggttccttaaatacctgaaacaaatcaattacgccgtcaccgaggcggaaaaggcgttagagaaaagcatccgcaacgaggatctgctagcgttgatgaagctggagaaaagcatggtattcttcaacacctccatccgcgggaatgaggtgatgctggccaagctccagaatattttccaagagccgcaatatatcgacaaggatttagtggaggacgtggagatcgagttgaaacaggcccataacacggtaaatatctatagcgatattcttacgggtacgatggacgctttcgcctctatcatctccaacaacgtgaacacgatcatgaaacgtatgacatcactttccattatcttaatggttccgacattaatcgctagcttctacgggatgaacgtcccgatctacatggaggatatgccgcatggtttcgtggttatcatcttgctctcgatcttgctatccgctacggcctttttcatattcaggaagatcaaatggttttaggatatcaaataaataaaccggacgcagatcacccgtgcttgtcggtgtcatctgcgtccggtaaatatcaaattcggtatatctttatcttggcttacttatgcgtatcctcgaggatataacgcaaggttccggcattcaccaattcctcttgcgagatggtgtagccctttagctttttatcgccggcgaaaacgtccttgatgtagatcgcttccggattactatgcttagactcgattaccaattcgcctttaggatagaatttcttgtcgagctggatcgtaaccttatcgaaagtcggggaagtcaatacatagttcacgtcgcccggacaagctgggtagaagcccatcatggagaaaatagcccaagcggacatcgtgcctgtatcctcgttacccgggacaccgttcggggcgttatgatagcaatccttcaacaactgacggaccaacttctgggtacgccaagcctctcccttgaaatagctaaacaaataaggataagcgatatctggctcattggcgggatcataattgccgtcatcgaataccttctgcaaatgatcgacaaatttcttatcgcctcccatcaatttggccagtcccttgatatcgtgaggaacataaaacgtataattccatgcgttgccttcatggaaaccgggactaggctcgaagttctcgccttgtttcggatcgaacggagagtagaaggtgccgtccggcaagatcggacgcagcgttccgaactccttgctataataatgtttgtaacctaaagaacggtcacggaataacttggcatcctctttcttacccaaggcttgagcgaaattagccaagttccagtcggcgatataatattccagcgcatgagatacggagttatcgtattgctcacgcaaaggaacatagcccttgctgaaataatcgttcgcgtccggacgaagcaggttgaactctcccggggtagtagcgcctttacgcatcgcctcataagcggtttgctcatcaaagtcacgcaagccgcgcatccatgcgtctacgatatacgggatcgagggatcgccttccatcgtaaaggtctcacgtccgtaaagctcccatttcggtaaccaaccgttttcccggtacatatccagcatcgtacggataatatccaattgacgctccggatagagcaaggtcatcaaggtacttacgttgcggtacgtatcccacaaggagaagaccgtataacggtttccggtggtatggcctactttcaggctctccatcatcgggtactcgccgttcacgtcttgcaggatattcggatggatcagcaaatgatacataccggtatagaatatcgttttctcgtctttcgtacccccttccacttgtaccttggaaagatccttgttccacatcgtactagccgccgtacggaccttgtcgaaatcgaagccgggctgctccgtattcatgttcaggcgggcgttctcgatgctcacgtacgagatacccatcttcacctcgatagcctcgccctcgtccgtatcgtaatcgaaccatacgccgacatcgtctccgctcatctcacgggtataactggtatataacttatacttgccggagtagatatcccattcggcctctacccccttcatctcacgttgtttcttccaataacccatcttcttcggggccttgtttaccttcatcacgaagtaaaccgggaatacggcctgtggattatagcagaacgtacctaaaagcttactcccctcgatctccgtatcattcacgatacgaaccgtagcgccggtctcgttcgtcaagccctcgcctaggttcaagaggatatggctctcccctttcgggaaggtaaaacggctcaagcccgtacgcatgctggcagtagcctccgccttgatattatacttggtcaaggtattgctataataaccggggtgagccacctcgtccttgtactcactgccgtaagccttatagtccacgttcaactcgcccgtcgtcggcatcaatagcaaacctcccagctccgggcatcccacgccgctcaagctgccgtgggcgaatcccgtaaagaatttattgtctgccgagtaaggagtagaccaccattgactatccttgtcaaaacggttcttctccgaccccatgacgttgaaaggaaccacgctcatcataccctgcggacaaaccgcgccgggattcgtcgtaccgtaattgctcgtaccgatgaaggggttcacataatctaccggttgctgcgccgtagcgaacagactgccacacaacaggaaggtcattaactgtttcttcatttgataaatgtattttagttgataattaattgattcatacttaccagatcacgatctcatccgtgaagatgaaacccttatttgcctcttttgccttgatacggatataacgggctttccaatcgccgttaaacgtatattcctgaaaagacaggtctttatccgtattggatatcgtagtagggataactccctgcgagatatagctctccccgtcttccgatgtcagcaactccacctctcccggttggtacacgcccgggccgatcaattgcataaagcgggacgataccttatggatatccgtcacctcgcccatgtccaccacgcaatccaagtcattcaaataaccctgccaacggccgtccagataagtcaagcctcccctatagccgtccagcaaggcgttcatgccacccgccatataaccgctatacagcttactattataatgtataggcttattgataccccggtgataatccaccttcttctcggtaggcgttccttgaagctgcccgtcacggaagatagcggccttgatatcagcggagtctttcaccacgatcggaccgtcatagacccgggaagaggcggtgggaatagaaccgtctgtcgtgtaacgtatctccgccggatatttctccgcatccaacatgaccttgatctctcgccgcaaggtatctaccttcatcgtggtctcgatctcgtccgagagcgtgaacgtatggatacccatccgttgcagaaccgggatattcgcattcatacgaggcttaaaatcctcccaactacgatcctcttgcggagtccatccaatctcggcgaccgccaaggcacgagggaacatcatatactccagatgcttctcatccttgatatactccgtccatgtattcgcctgtacccctaggatatgcttactttcctcggcagtcaacgaatccacaggcaccggattataactgtacgcccgcttgatcggcgtataaccgccgatggcatacggctgtgtcttcggatcggcttgatagaaatcgaaatacatataaccacccggtgtcatgaccacgtcgtgtcccatgcgagcggacttgattcccccttcctcgccccgccaagacatgacggtagcctccggagccaagcccccttccagaatctcatcccaaccgatcaatttgcggcctttggaaatcaggaattcctcggcacgatgaatcatatagctctgcaactcatccacgtccttcatcccattccggcgcatcaagccttgacatttcgggcaggtcttccaagctcccttcccggcctcgtctcccccgatatggatatattcggaagggaacaactcgatcacctcggacaatacatcctccatgaacgtaaacgatttctcgttgccgatgcagaaatcacccgtcgtataaggtttgccggcacaactcaactccgggtacgccacgaacacctcgtccgaatgccccgggaattcgatttccggtattatattaatatgccgggccgtagcgtaatccacgatctcacggatatcttctttcgtaaaataaccgccatatgcccccggagttccttccggcagatacttgcgatcctttccatcccaccatttctgccaatcggattccgtacggaaagccacgtccgtagtcagtttcgggtatttatccatctggatacgccaaccaccggcatccgtcaaatgcatatgaagcgtattcaatttataataagacatgacgttcaataacttcatcacctcctctttcgggaagaaatgacgggagacatccagatgcaagccacgatacgggaaacggggattatcttggatcgatacgcaaggaatccctttcgacgtatacagctggcgcaacgtttgttccccgtaaaacaatccggatttagaggcggctctcaactcgatccccttctcggtcacgtccaacgcatatccctccggattcccgccattaaaagactcatcgaccacgtaacggatcgtacccgattgatcattcccgaatatgagattactatctactttgaaataaccgccagtcacctcgatatgggccggcttagggattaaattcacctgcgaaacctccttgggaacacaggaaaaaagtagcgaggagcaagcgagagcaagtccggttactttcatgcaagaccgttttggcaacgtcataatacttattttttagttgtgttattcttggtgcgtaaatatacgacaataatggacaatatcaaaaaagcggaaagactatcgtctccccgcttcagagttattttaagatgtatatcttctaaaattaacgtctaggaattgcttcttttacaaccatctgacgaccttcgtactcagcttggtttaattcctcgatagctttttgagcctcgtctacgttaggcatttcagcgaaagcaaaacccttagaacgtctagtatcacgatcaacaattaactttactgaatcaacaacaccatactcttctaatacttgttgcaaatcagactctcttactcgataactcaagtttccaatgtaaatattcatacgaaaaaaattaaaaataaattaataataaaacaagtgatgttagtgaagatcgatttctagaagaatatattatcattactgagaatagaaactcgaagataaagagcaagacaaactatcttttgtttgttgctacaaaggaaagcattctttttggattaccaactataaaacctaatttattttcaaaataattcactttatcttcagaagactacttatatgagctaacgagactatctgcgtgaaccgcataaaaaagaagagaatctaattaaagatcctcttccctatttgaaaaagccgcactgtagatgtgaacaaactccgtatgacaggatttgagtactttgccacctttgtaatccgccgtgctaagcataccccgaagggcgcggcccgccattggcgacaagagctatgtctcggaattaaaataaactgatgagtttcccaatcgaacaagtgcggcttaactcattccctgtttatctttttcttgttacaaagatatgtaatcgtatcgacataaccaaacaaaaacaacaaaaaaagagcctccttttcggggaggctctttattaactatatagcaaaaatcttattttactttagctacgatagccttgaatgcttccggatggttaacggccaagtctgccaaaaccttacggttgatctcgataccggcagcgtgcaaagcacccattaggcgagagtaagacaaaccttccatacgagcggcagcgttgatacgctgaatccacaaagcacggaaattacgtttcttgttacgacggtcgcggaaagcataagtcaaacctttttcccatgtattcttcgctacggtccaaacgttcttacgtgcaccataataaccgcgggttagttttaaaatccgttttctttttgctcttgaagcaacatgatttactgatctaggcataattctaatctgttttgaatgttagcgtcatctcgtaggatgaacttgattgctaatgcattcggttaataaaaatcgttataaaactcgcttaatgaataaagattacttcatgcaaagcatctgctttacgttgcttacgtcaacactagctaccaaacccgtgtgagtaagatttctcttttgcttcttagtcttctttgttaagatatgactcttaaaagcgtgttttcttttgatctttcctgatccggtaagggcgaacctctttttggcaccggaattagtcttcatcttaggcattttccaattatattttaattattaaacttaacctcccttctatcagggacggattttattcttctgttttcttatcaccctcacttttaggcttaggtgtcgtaatcactttctttacaactttcggagctgcggccgcagccggggctgaaccagtgcccgctttcttcggagtaagcatgataatcatacgttttccctccagaaccggcaactgctctacttttccatagtcctccaaatcgttggcaaaacgaagcagcaagacttctccctgttccttgaaaaggatagaacggcctttaaagaacacgtaggctttgaccttcgaaccttcctccaaaaatcccttagcgtgcttcaatttaaaattgtaatcatgatcatctgtctgaggcccgaaacgaatctccttcacgaccactttcacagatttcgctttttgctctttctgacgctttttttgctgatagaggaatttttggtagtcgattactctacaaacggggggcgcagcatttggtgaaatctcgactagatccatcccctgctcttccgctattttcagcgcttgagcgatcggataaacacccgtctcaatattgtcacctactaaacgaacttcacgaacacgaatacgttcgttgattctatactgttctttcagattgtcattcttcattcaaaaagatttattctcctcgttattagttatttaatcattacttttttgccagcgattcatcatttcctctacctcgccattcaaaagcgctgcaaaggtagcaattttcatcgaacctttatcaccttcgccctgttttcttacagaaacttcactattttctgcttctttttctccaacgatgagcatataagggattcttttcaattcattgtcacgaattttacgaccgatcttctcatttcggtcatctacgatagcacggatttcctgattacccaactcacgcgcgatttgccaagcgtaatcattaaacttctcgctgatcggcatgatacatacctgctccggagtcaaccacaacgggaactttccggcggtgtgctcgatcaatacggcaacgaatcgttccatggaaccgaacggcgcgcggtggatcataaccggacggtgcttctggttgtcggcacccgtatattccaattggaaacgttccggtaagttatagtctacctgaatcgtacctaactgccaacggcggccgatagcgtctttcaccatgaagtcgagtttcggaccgtagaaagcggcctctccatattcgatcttagctttcaagcctttttcctcacaagcctctacaatcgcttgctcagccttctcccaattctcgtcgctaccgatatatttctcacggttcaccttgtcacgcaaggagatctgagcctcgaagttctcgaaattcatcgtcttgaatacgatcgagatgatgtccattacgttcaagaattcctgctttacctgatcggggcggcagaagatatgagcatcatcctgcgtaaagctacgtacacgggtcaatccgtgcaactctccgctctgttcataccggcaaaccgtaccgaactcagcgagacgcaacggcaggtccttatacgaacgaggagagtttttatagatcatacagtgatgaggacagttcatcggtttcaagaagtattcctcaccctcctcaggtgtatggatcggttggaaagaatcctttccgtatttagcgtagtggccggaggtaatatacaataatttattaccgatcggcggacacattacctcttgataattataacgagcttggatacgacgcaagaactcttgcagacgcaaacgcaaggcggtacctttcggcaaccacatcggtaagcccttacctaccgtatcggagaacatgaacaagtccatctccttaccgatcttacggtggtcacgtttcttggcctcctccaacaatgtcagatactcatccaacatcttctttttcgggaaagtgataccatacaaacgaaccaattgcttgcgtttctcatcgccacgccaataagcgccggctacgctcaatatcttgacagctttcagataagaggtattcggtaagtgcggccctctacacaagtccgtaaaagaaccctgtgtataggtagtgatcgtaccgtcttccaactcactgataagctctgttttatactcttcacctctatcgccgaacatcttcatggcatccgccttggtaatgtcctgacgtttgatctcttctttcttggctaccagctcaagcatcttagcctcgatagcagcgaaatcaccctctttgatcacggcctcacccggatccacgtcataatagaaaccgttctcgatcgccggaccgataccgaatttaatacccggatataattcctgcaaagcctctgccataaggtgagcgctggaatgccagaacgcatgtttaccttcctcgtcttcccacttcaaaagtttcaccgtagcgtcgtcgttgataggacggcttaagtcccaaacctccccattcacgcttgcggctaggacttcctgtgccaaacgagaactaatgctttccgctatctgcatagcagtcgttccctttgcatattctcttacggaattgtccggaaatgtaatctttatcatattctattctctaaaattctttatattcagcccacaaagttaatatttcttttctatcagcgaaacatttaactcgaataatttgcgttatcaccggcttgtcattcgcttgatgatactataggcgttgtagatacccaattcccctgccttgctcaagtcggcgatgccccggttcacgtcaccttgcgacagacgggctaacccacggttgtagtaagcctcggcaaattcagggtcccgctcgatcgcctcgttgtaatcaacgatagcggcacggaaatcacgctgggcgcaacgcagattcgcacggttaaagtaagcgtacacaaaacccgggttcagcttgatcaccatatcgtaatccctcatgatctgctcatgctcataggctcgcttattatccttcagcatagcgctccggaggtccaccgaggtgttggcgtttacctgcgactgtgcggacttaccaatattcaagttcattcccgagccactcaagtcgtacgtatccttgctagcctgctgggattgggtgtacatcaattgcttataacgttccacggcacgattgaaataagccatcgtgaacgacgggtctcgctcgatcgcttccgagaaattcttgatcgcctccgagaaatcctgcaccaacatgaagtccatcgcacgaccgaaataagcgttagcgttgttcggatcacgctcgatctccgccgaatactcgtcgatggaggcgaaatgcacggcgatctggtcctcggtcaaagcggcctcctcgttcgtgatacgcaatttacgcttcaagaccatctggccattgtaatcctccaccatcttgtcgtaataaacaagtttctttacgggatccgccttctcgtaataggtcaagacaaactggggttccagatccacatggacattccggtcttgtacacgcccacggacctcactttggtatttacttttacgctcctgctccttatcgtataccaccaagcggttgaacttattgatattcttatcggattgctcacgagtattctcctccgaatcgtccgtcttggcatctccgttcaccgctgtattggagctagaagacgatgtcttcgggagctgtccgttcttggcctgctcctccatctttatggctgcccaataatcacggtctgcccccacgttatcccctagcttacgctttgcttccgaacggctcacaaagcctggcaggaaagtaggatattgcttcaagaccacgtcgtaatcctgcacggccccccggtagtcgcccgtctcgaaacggagcaacgcacggttgtaataagccatatagttatctggctcttgctggataacgacatcgaagtcttcgatagcacggttattatccccgacttggaaccgaagcaaacctcggttgaatcgtgcgatcaagttccggctatccatgctgatcacctgatcgtaatcggccatcgcacctctcaagtcattcatctgataacgaactagcccccggttaatataatatccgctctcacgggtatccagacgtagagcctcgttcaaatcggccaaagcgtccttgtaatcatccatttgataatgaaggatcgcacgattgccatacgccggcgcataataaggatccatctcgatcgccttattataatcggccaaggctttcaacgtatcccctttctccagatacatagcgccccgtgtcatataattcatggaatatttcggatgggcggtcattaaatcatcgaatgtcttctccgccccgttatagtcttttttctggataaaagccaccgccatattcaccagcatctggcggtcctcgggtttgaactcaagtcctttctggtaatcgtcgatcgcctcgtcgtatttctcctggctttgacgggcgatgccgcgagcgtaatacgcttgcgttaaaaaagggttccgctgaagacataaagtacagtcttcctcggcccccttaaaatcgtccagatttatcttcgccaccgcacggtaaaaatagggttccgccaaccaaggtttggatttgataacctgattgaagtactgaatggaaagaacataatcctcaaaataaagggcgttcctgccaatggccaatacacggtccgtattaatctgcgcaaaaagcgaaatcgtaaatatctgtaatatcaaaaagagtgttgccttcttcatcctattaaaaatgattgagaggcaaaaataagtaaattatcttacttagactctatttttaccattaaatgattcttcgttatcttatcgccctcttttacattgagctcgacaacgactcccgatatgggagcgatcacccggttctgcattttcatcgcctcatggattagcagaagttgcccggcctccacagcctgtccttcctctaccataatcttgataatcgttccgggaagatgagaaaccacgtcaccagccgacggcttatgccacatcggtcggctcttatacttcgctgtcagcaacgtcttatatttacgtgccgtcaccacaaagtctacatattcttcttgctggtgtttcttttccatactctcatcaatttagaacggaggcaaaccgtgcttcttggccggtctgtattcctcttttagaatggaaagcttcagtgcgtgtagcaataatgaacgggtttctttcggttcgatcacagagtcgataaatcccttggaagccgccacgtatgggttcgcgaatttctcgatatattctttcaccttctcctgacgcatagcgttctgatcttccgcctccatgatctccttgcggaatatgatgttagctgcgccttccggacccataacagcgatctccgcgctcggccaagcgaacatgaagtcagcgcccaagtgacgggagttcatagctatataacctccaccgtacgccttgcgcaagataaccgtgatcttaggaacagtagcttccgaatacgcatacagaaccttagccccatgacgaatcacacccgcatgctcttgatctacgcccggcagataacccggcatatcctccaacgtgatgataggaatattgaatgagtcgcagaaacggatgaaacgagcggccttgtcagcgctatcacaatcaagcacgccggccaaaaccatcggttgattggcaacgaaacctaccgtttctcctgccatacgaccaaaaccgatcacaatattagcggcccacaactcttgaatctccaagaagtccgagtcatcgacgatacatctgataacgtctcgcacatcatacggttgtttcgggtccgccggaactacttgctcgatattcagcatagcggacggctctttcggctcaaccactttcgcacgctcctgattattccaagggatgaagctaaccaaacgtttcacctgatcgaaacattcttgctcgctcaaggcataaaaatgagcgttacctgtagtctccgcatgaacacgtgcgccaccaaggtcttccatagagatatcctcacccagcacggtcttgataacgttcggtcccgtgataaacatcttagagatgttctcaaccacaaacacgaagtccgtcaacgccggagaataaacggcaccaccggcacaaggaccgaggatcaaggaaatctgagggatcacgcccgaggcgatcgtattgcgatagaatatttcaccataaccagccaaagcaccaacaccttcttggatacgtgcgccacccgagtcattgattccgatgatcggacatttcatcttcaacgcatgatccatgatcttggtgatcttacgagcatgctgcaaacctaacgaaccaccggcaaccgtaaagtcctgcgcatagatgcaaaccggggcaccaaagatcgtacccgtaccagtaaccacaccatcacccggcagaaccttcttctccataccgaaatcacggccatcgtgtttcacgaacatgtcatactcatggaaagagttcttatccaacaaagccaagatacgctcccgggcagtaagcttacccatcgccacttgcttttcgatagcagcctcaccaccgcccatctcgataacggctttcttttccctgagggcctcaatgtttttacttaaatctgtcatattgattatttatagatttattatttaccaacggcttttgcccggtaagagcaacgaaccgtccctttaataatactatttaatttgcctttgttcaattggcggcgaatagcggagacattgtctataaagacatgccccgtcagatgctcgcactcatgctgcacgatacgggcggcgaaaccttccaccacttcctcgtgttcctcccaattctcatcccaatatctcacacgaaccgttttcgagcgagacactttctcgtgtatacccggcaggctcaagcagccttcctccatagctatttcctcctcgctacgttccaaaaactcgggattaatcaacgcacgcttgaaacccttgcattcagggaagtcatctcccatcacatcaccgtctataaccaccaaacggatagacaagcccacctgaggagcggcaagccctaccccatcagcattatacatcgtttcaaacatattggcaaccaactgtttcaagtcgggataatctttaggtacatcctcagcctcttttcttagtacgggctgaccatataaaaatacgggtaaaatcataagttataactgatattttttactttctaaataagcttgcaaaataataacggcgctaatctcatcaaccaatcctttatcttgccgtttctttttctttaaaccgccttccaacatggccttatgagctaagaccgacgtgaaccgctcgtcgtaataagttaccgggatacttggtatcgtccttttcagatgggtcacgaacgcctccacatacttcatgttctcagaaggctcattgttcatttgcttcggaagcccgaccacaaataaatccaccggttcccgtgatatgtaatccgacaggtatttcacaacctctccacttgggactgtcgccacgccgttagcgatcatttgtaaaatatccgtagcggctatccccgtacgtttccggccgtaatctattgcaattattcttcccatcgagcgcgaatatagcataaatataaatacagattacacaaatccgcaaaaagtgtgcaacaaatcggatcaatatgcattcttctctcccttgaacatattcagtaccgtaaccacaataatctttaaatcaaggaagaacgtccaattctctatataccacacatctctcttcacacgtccttccatctgctccagcgtcttggtctcacctcggtaaccggtgacttgcgcccaccccgttactcccggtttcaccaaatgccgcaccatatacttatcgatcaacgccgagtactgctcggtatgcttcagcatatgcggacgagggcctaccacggacatatcgcccagcaagacgttcacgaactgagggaactcatccaaattcgtccggcgcaagaaatcgccgatccgggtcttccggggatcatccttgacggcctgcaaggtatcggcctgcgcgttcaccttcatcgtacgaaatttaaaacattcgaagtcatgcccatacaatcccgtacgtttctgcttaaacaaaatcgggccgggtgagcttaacttgatcattataccgaccacgatgtacaggatcggataaatcgtgagcaaaatcaccaaagagaaaaatatatcgaacgttcgtttcaagaaccggttataggcggattgcaaaggctctcggcggaccgtcagcaatgggatcgattccatcacctccatcaccatactcttctttacatcccggtaaaactcgggcacgatatagaagcgcaccatcttcttctcggcgaaattcagaagccgtacgatctttccgttgttcgtacccggcaaggtacaataaatctcatcgatatcatgctccagcacatacgcttccacctcgctcgtcttgcccaagtaattaggtaaaacgtctttcaacgagtcattgtcatcaaaaaatccctttacgctaaacccatagctcaaatcatctttcatgacttggtaaagctccataccattctttccggcccccacaatcaccaccttcttaaagttatagccttttcgcctgtacaactttaaagataggcgcaccaaaacccgccaaagcgaaaacaagatgatagaaaccccgtaatagaccaagaggaaggttgccagaacatctcccacattcaagaagatcaagcaagtagcgaacaagaagataagtacggtaaccaatccgaacgcccgttgcacgatcttgtcgataaacacgaccgcctgatgcaattgaatcgggataaaatataaagagaagaaataacagaagttcaataacagaataacctctctcaaattataggatatcgcttccgtgtatttcgggccaagcagatgaaaaacggccataaacaaaagattcaatacgatcaaatctcctacaccaatcagccattggattaaataaccatgttttttgttcaatatcatagcaattcgataaattctcacaaaagtaagtatttttcggcgcaaaaaaaaggccgcacttagaagtacggcctttttaaagtattaattcgtaaattaattattagcgctcataattactacacggttccagctattttcgccataaggttgttcgtccgaacctctccactcgatagtgatctggctagaagagataccgtatttatcgataagttccttagcgaccgctctagcacgtttctcagaaagacccatgttataatcagaagtacccgtcttcttgtcagcgtaaccaactaccttgatcggagcgttgttgttcttcatgaactcagctgtgttatagatattgatctgctggttcttgtcgatcttagcgctgttgatgcggaagtaaaccacattgtcaacgtagttatttacaacttcagtaactgtctcttggcactcagggcaagaaaccggacgtttgctcaactcatcgttagcagcacgcaaagagttgatctggccgttcaagtcgttcaacaaagcgtaatccatcggctccaatacctcgaagtctgtcttacccaatttgaatgtcaaaccagcgctcaactgaacgataccatctgtcaggtgattcatctcgacgcggttaaactgctcgttcaacaaagaaccttggatctcaacgttcaaatcaacacgtttgctcaaacggaaagcggttaagataccagcgttcaacgtaggagactccgttcttggacgatcataagactctgtagtcttgaaacgctgcgcataaccaaaaccgacccaaggaatcaagcggaacactttagattctctgtaaggagcccaaaagttagtaacatcccacaacaagtctacgtgagcggctacatatttattatgttgcataaactgtgcgccatcaccttcaaaaccgtggataataccaccatttaactgggtacggaatcctaaatacggattaaaccacttaccaaaagatacttgtggagcgaagtttaaacgattcttgaaatcagcctctccattttggtctcctaacaatacgctggctccacccgcaattgaaataaaccaattgtcgcgagctttattcttcttgaaattagtcttataaccagcctcattgctgaaccccacctgcggttgatattcctgtgctgtcacagagaatacaaaacctgataacaaagctaaaagtaaaaccttagtcttcatattttcaacattttaattaaacaatcaattacctaatatcttaaaattggcacaaatttaactctttttgtaattacaacaaataaaatcttcaaattgtttcgaactcactcgaaatagttcaaaattttatagcccccctctttcagataagactccttcttcattagttttatatcgttcttcatcatatcctcaattaaagccgctaatgaatactccggttcccaccctaaacgagtacgtgccttcgtagcgtcaccgatcagcaactctacttccgtagggcggaaatactgcggatctactcccacaacttcctcacccacacgtttcttaaagttttccagataggcatcaccaaccttcttgacgaacaatccctcgtctatcgactctatgatagcgacctcgtctatcccttctcctttaaagcggattcccacgccaatttcctcaaaagccatacggataaagtcccgaatcgtggtagtaatcccggtagctatgacataatccgagggttcatcttgttgcaaaatagcgtacatggcacgcacgtaatcttttgcgtgtccccaatcccgtttggaggaaagattacccatataaacctttttttgcatacccaaaacgatacgtgaaaccgcccgggttaccttacgggtcacgaatgtctctccccttaatggagactcgtgattaaacaagatgccattggaagcgtgcatatgataggcctccctgtaattcaccgtaatccagtaaccgtatagtttcgctaccgcataagggcttctcggatagaaaggagtagtctccctctgcggcacctcttgcaccaagccatacaactcggatgtagatgcctggtaaatacgcgtcttcgggatcaagttcagcaaacggaccgcctctaggatacgcaatacgcccaaaccatccgcattcgcagtatattcgggagtgtcgaaacttacttttacatggctcatggcggccagattatagatctcgtccggttgaacctcgccaatgatacgtgtaagattcaaactatccgttaaatcgccataatgcaaaatcaaattacggttttccacatgcgggtcttgatacaaatgatcgatacggtccgtattgaacatggaagaacgacgcttgataccgtgtaccgtatatcctttcttgatcaagaactcggtaagataagccccatcctgtcccgtaatacccgttattaacgctactttgcccatttctctaattttcaattttcaattctcatttttcaattcccaagtaccattcatagagtcgcttcacgccctcctcgatctcgatcgtatggcgccaacccaaggcatgcaacttgcttacatccgtcagcttacgaagcgtaccgtccggcttggacgagttaaacctcaactcgccctcgaacccgatctctcgccggatcagttcggcgacctcacggatcgaaagctcgatacccgtacctatattaatatgtgtattccggacctcgccctccttctggcggacatcctcgaaatccacgtgttccatgatataaacagaagcgtcggccatctcctcgctccataaaaactcacgaagcggcttgccggttccccacagctccacctcgcccggacggataccctgtttatccaatacggagagtatctccggctcggaggccttcccagacacgccctctaccggacgaatgtccatatccttacgcaaggcctcccaatctcctgtatgcaggcatttcgccatatgtatcttacggatcatggctggcaacacatgcgaggtctccagattgaaattatcattcggcccgtagaggttagtaggcatcacggcgatatagttcgtaccgtattgcaggttgtaactctcgcacatcttgatacccgctatcttggcgatcgcataaggctcgttggaatattccaagggagatgtcagcaagcaatcctccggcatcggctgcggagcctcacgaggatagatgcaggtgcttcccaagaataataatttctttacattgtttttccaagaggcatgaatgacattattctggatcatcaaattattgtagataaaatcggcacggtacagactgttcgccatgataccgccgacgtgcgccgccgacaagaacacatagtccggccgctcggctgcaaagaactcgttcacagcggcttgatccgtcagatccagttccgcatgcgtacgaagcaggaagttcgtataccctttgctacgcaaattattcaggatggcggagcctaccaagccccggtgaccggcaacaaatattttactgtctttttccatcgatatctcgtattctgaactacttctacttattaatcaacctcatcaaatactggccgtactgattcttaatcatcggcaaagccacttgctcaagtcgcttctcatcaatccatccttgcttgaaagcgatctcctccagacaagccaccttcagtccctgtctcttctcgatcacctccacgaaagtagatgcctcagacaacgagtcgtgagtcccggtatccaaccaagcgaatccacgtcccaatagctgcactttcaactccccatccttcaagaaccactggttcacggtagtgatctccagctctccacgggcggatggcttgatattcttggccacgcccaccaccttgttcggatagaaatacaaccctaccacggcgtaattcgacttcggttccttcggtttctcctcgatactgaggacgttcccatccgcatcgaactcggccacgccatagcgttccggatcgtttacgtagtaaccgaacacggtcgctttttgttcgttctccaccttgtcaacggcctcttttaacatacgggtaaagctctgtccgtaaaagatattatcgccaagcaccagacaaacggagtcatcgccgataaagcgctctcctatgatgaaagcttgcgccaatccgtccggcgaaggctgctcggcatattcaaaacgaacgccataatcggagccatcgcccagtaaacgacggaagcccggcaaatcctgcggggtcgatatgataagaatctcccgtatccccgccagcatgagcacggataccggataaaaaatcatcggcttatcataaataggtagaagttgcttggaaactcctttagtgatcggatacaagcgggtgcccgatccaccggctaaaactatacctttcatattctttccattttgttcgacaatactcgcttaggatcgattccacaccgtccctaaaactatacaaagttaaacaaataataatagattagcgtatcgttttcaaaaaatcgtccatattctgatacaatgggacgccatagcgcgcgcaagtcaagcgcacattatcataccggtaaaagccgggctcgcaaatcacccgcaactttccggagcgcataaacagccccatctccaataaggttatcggggatttgctgctcgccagaatgttcatgataatcaggtcggctttctccagatgctccagttcccaattcacttgatgctcaaaatcggacatctccccgctcagccctttatccctgcgaggattgaacaagagataccgtccctccggaagcgcccggaaccagtcgcaggtagccttctgccaatccacgcttttccccatatcgatcgtgccggcgagaaagatcttctggtagaccgtctcatccaagtctgcccctttatcatccgggcgcaagacgataacctcggattgggcgaataatcccacgggtaataaaagagataagaataaaatcagaaatccccgctttccggcggtaagggatttatcgttcgtaagtttcatataatggtagagttattttatgcaaaaatagggaaaatccatggatatacaaaaccctcttgcttccgtatgaatactatcccacaagcttatccatacttgttcgcaagccgtctaattctataatcaccgccactgattatagaaccgccgtcagcgatcgtacaatcagtggcagtgatcatagaatcagcatcggcgattatagaatttattaagatgcgacaggctttgttgatagagagaagattgtttgcttcatggagaaacaagctttagagcgagcgaaagcagactcttcatggattcagcccataaatcgtagcctgtacggcatgcgataagatataggccgcaggcgtgtcgttcgagggggaatagcctttggagagcctctggattacgggctccttgttcgtgcccagtatcgggaccaataagggggcgccgttcaagataagcggtcccgtcatggtgatccggtattggccggtagaaggttgctgggataccgcatagttacggctatccgacaatagctccatggtggtagggaaaatggatgccgtatgtgaatcctcgcctacgccgaggatgatgcaatcgaacgtaggcatttggttgaacaacggcaagaattcctttacgacccatgaataacgcatcgcctcggtacccggctcgttctcgcccttgatccggtggatatgatctgccgggatacacaaaggcttaaaaagcaaatgattcgcatgaccgtaattactatccgggcatgtcggtagaacgcaacgctcgtccacccagaagaaacggatgttattccagtcaatcttatccttatactcatctacccagagggaaaacatatgcttcgccgtctcccctcccgagagcgctaggttaaacggagcgaagtctttccggcgaatcatcgccatcatgtcctccgtcatcgaccgaagcgcctctttcctctcattatatctctttatttccataaaattatcttctttggcaggcgcagactttcttttccgcacctaaaataacagtttcctccggtccgtcctcgcccggctcatagaagaataagttcttcgaaccctcctctttccaatggagcaagatcggatcgataaatttccagctagcctccaaagcgtcgctacgagcatacagggtggaatcgcccagcatggcatccagcaacagacgctcgtaagcgtcaggaagatagctcttcgagagggaatcgtagcggaagtccatgctgacttgcttcacctcgaaaccggctcccggcattttcagcccgaacttcaaggatatactctcgttcggttggatacggatggtcaatttattgcaggaacctcccgaacattgaccgacaaacagttgatggggcgtagacttgaagtggatcactacctccgatgacttctccggcaacttctttcccgtatagaaatagaagggcacaccgctccagcgccagttatcgatgaagaatttcatcgccacatacgtctcggtattcgagtcgggagctacgttcttctcttcccgataaccgatatattgtccgcggacaaccatcttatccatatccaacaccgtatacggacgtatggagcggaatactttcacgatctcgtcacgaatcggttccggctcgaatatagagggagattccatggcgataaacgacatcaattgcatcaagtgattctggatcatatcccgcatcgccccggctccatcataatatttccctcgattctccacccccaaagtctcggtagcgctgatctcgatggaatcgatataattatgattccacaatggctcgaaaataccgttcgagaagcgcaataccaagatattctgcacggtctctttccccagataatggtcgatacgataaatctcctcctcatggaagatatgtcgtaaatgatcgttcaactggcgggcagactccaagctggtgccaaacggcttctccacgatgatccgccggaaaccatccggagactcggtcttgttcaaaccactctccagcaaacattgcgggacgatctcgtacatcaccggcggggtagccaagtaatagatgatcttatccggcaagtcatgtttctcttgcaagaactcgatgcgctcacgcaatttgtagtattcatcggcgttggtggaatcgaaggcgaggtaataaacattctccaagaagtcatcgatcaagccctcgtcgtaggtctttcccttctgtgcctccaagatatgcgtatgttgctccgcacggaactcctcatcgccataagcggtacgggcggctcccaagatgcagaagcggtcgggtagcaagccacgaacatataactcgaacaaagagggaagcaacttgcgactggtaagatcgcccgacgccccgaatataactaataattgattatctgctttcttcatgtctttatacgttataagttccagaaaccgtctttcctccctcacccgtccagttggtatggaaaaacttaccacgctcccaatcgacccgctcataagtatgagccccgaaataatcccgctgggcctgaatcaagttagcggcggaatgcggggtagacagtccatcgaaatagctcaaccccgagctcatcgccggcaaagccactccatgcaaggcaccctcggctaccacttgccgccaagccaacaaggaagactcgatcttttgaataaagaactcatcgaataagaggttctccagattccggttcttctcataagcctgcgtaattttctccaaaaagacagagcgtatgatacatcccttccgccagatcttggcgatcgtaccgtaatccaactgccaatcatatcgcttggaggcttggcacaacaaagagaatccctgtgcgtaggaaaccaacttagcggcatacaaagcctgcttgatctctttctccgagattaaggtctgccccagcacgccactcttcggataaagcgaggacgcttttttccgttcttcctgcatggaagaaagcatacgggcataaacagcctcggtaatcaatgtcagcggatcattctcgtccatagcggcgatagcgctccatttaccggtacccttctggccggcggcatccaatatcttatctagcaggtagccctcccccgcctcgtccttgaagcggagaatatcggccgtaataccgatcaggtagctatccagctctcccgtgttccaatcctcaaagatacgagccaaggcctcattgtccagatccagacgattcttcaataaggaatacgcctcggaaatcaactgcatatctccatactcgataccattgtgtaccattttcacgaaatggccggctccacccggaccaatccattggcaacaaggcgtcccgtcgtccagcttggcggcgatgctttgcaagacatccttcaccaaaggccaagcggcaggcgaaccacccggcatcacggaaggtccgtacaaggcaccgatctcgcctccggagattccggtacctacgaagtacatcccatacgcctccatctccttcacccggcgttccgtatcatggaagtccgagttgccaccatcgataatcacgtcaccgggtgataagtaaggaatcaattgagccatcagctcatccaccggggcacccgcttttaccatcagcatgatcttgcgaggacgctcgatagactcgacaaattcctgtatcgtatgggttcctataaaattctttccttttccacgaccgctcatgaagcggtctaccacgccttcctctcccggcgctgtacgattataaacggatacggcgaaccccttgctttccatgttcaacgcaaggttttctcccatcacggccaagccgattaatccaatatttgatgttttcatatttatgtttttattttattaatccaaatagatcatttaaagcctcactcatcgacggatgggtgaatatcgaatcccggaggaacgtgtaatcttgcccgagacgcatcgccaagctaaccgtatttatgacttcgctggactcggcgcagaataaggtacatcctaggatcttcccggtatccgcatctaccacggctttcagtaagccatccgtctgctcgatggtacgggtacgaggcatggcggcggcgggcaggctggccacctttatatttttctccatcttacgggcttgcgtctcgttcaacccgacatgggccaacggaggatcgatgaatacggaataagccactgcttcccgatcgtccaagctccggaaaccattaccaaacagctcttcccggataatacggtaatcatccaaagacagataggtaaattgtaatccgccatgtacatccccgatcgcccagatattagggatattggtacgcaacttactatccacctcgatagcgccacgattagtcgtccgtattccggcggcttgcagatttaggctttccgtattcggtttacggccggtagccaaaagcaccgcctcggcatccagccgcaaggtatctcccgagatagcgttacggcagatcaccgtagcccgctcggcatcctgctcgatcgtctgcacgaccgtattcaaatgaatggtgatcccttttttctctagcgtggacttcaccgaatcggcgatgtcccggtcctcacgaggaatgaacacctccccagcctccaagatcgttaccttcgatccaaaaccggcgaacatggaagcgaattccagcccgatatatccgcctccgacaataaccagatgccgtggcagtttctccagttccataatggaagtacttgtatatacgtaaggattatcctcgataccgcatatcgtaggaataatcgtcgtggctccggtattgatgaatatcttctcgccttccagcaagaaagagtccgtatccgttttcacgacaatctcataaggggaacgaaaagaagcctctccggtatagaccgttacggtctcccgatcatccagattcttgaaattcttctcacgaagcaaagaggtcagtttctccttggcgaggatagcctgtttaaactcctccgcatattgctcgaaggtagaaggtctgcgataccctgtcacttgagcgtaatgtacaagcgctttcgtcggtatacagccgatattgatacaagtacctccgtacatacccgtcgaacgctccaccacagctacattccatccatggttggccaaatccgccgccaaggtttttccacctttcccaaaaccaataataatcgcgtcgtactttttcatctctgatttatcttcttttcgttagacattaaaataacattcgttttaacctaattgttgcgaatttcatatcgcaaaaatagctccagcccctattttacaaaatggctgttcaacctataagtttagccatttttcccgaaacaagaaaataacgaacaaataccccctattttttgttctttacctataatatttataccctatgatcacaacacttataatactggccctatcagccgttttctttgttaatggaaaattacgttccgatcttgccgctctatgcgccctcgtcttattaatcgtatgcaacatacttacacccgaagaagcgctttccggcttctccaatcctatcgtcatcatgatggtcgggttatttgtcgtaggaggagctatctttaaaacgggattggccaagatgatcagcagcaagatactccgtctagcgggaaaaagcgaattgaaattattcatattgatcatgatggtcaccgcttttatcggggcgttcgtcagtaatacgggtaccgtggccctcatgcttccgatcgtagtgagcatggcggcaagcgccaatatcagtcccgggaggttcttgatgcccttggctttcgctagtagcatgggcggaatggccacgctgatcggtacgcctccgaacctcgtggtagatgaggtgctatccaacgccggattcacggatctatcgtttttctcgtttacgcctatcggggttatttgtgtgcttatcggcttggtcgtcttgattcccctaagcaaattcttcttggtaaaaaaggaggatggcaaagacacgaagactacaaccgggcactccccaaaagagttagccaagaaataccaattatcggataatctatatcggatacagatcaggcccggttcccggatcggagggaaaaaattgcaagaattaaatattacgcaggcttataatctctccattctggagatacgccggcagtcgtcctctcaaggacgtttccttaaaaccgtagaccagtccttagccggcccacatacggaattacaggagaacgatatcctctatgtgttcggcccgttcgagaaagtaaaccaattcgccaaagaacagaatctggagcttacggatacccacgtatccgaatatgttgaaggggcggaagttgaaaagctgagcgttcgggagatcggtatcgccgaggtcttattaatgcccgactcgaaattgataaataaggtggtaaaggactctggtttcagggataaatattccgtgaatatcttaggcatccaacggaaagaggaatatatactgaatgatataaaagatataaagatgcatgccggcgatatccttctaatacaaggcacatgggacagtatcgctcgcatgagccagaagcaatcgcaatgggtggtattgggccagcccttagaagaggcctctaaagtcactctggattataaagcccctgtcgccgccttgatcatggtcttaatgattgccgccatggtattcgacttcatcccgattcctccggtagcggcggtaatcatagcgggaatattgatggtattaaccggatgtttccgtaacgtggaagaggcttataaaacgattaattgggaaagcgtagtcttgatcgccgccatgttacccatgtcgctagccttagagaagacaggcgcctccaatcttatctcggagaaattggtgagcggactaggcgattacggaccgctcgtcttgatggccggaatttatttcaccacctcgctactgaccatgtttatcagcaacacggccacggcggtactggtagcccctattgcccttcaatccgccatagccatcaacgttagcccttatccgttcctgctggcggtgacggtaggtgccagcatgtgcttcgcctcccccttctctacgccacccaacgcactcgttatgtccgccggaaaatatacatttatggactatgtaaaggtggggttgcctttacaaatcgtgatgggaatcgttatggtatttatattacctttattattcccattctaaacattcgcacacgcattttagttttatatttgcagtttgtaaaacagtacaagaaaatttatggatataccgtttaaaccgattaggttagaagacaaagagatcataacctcatttacatttcccagcgattatcgcaattgtgatttctcattcgcgaacatgtgcagttggcgtttcttatatgacagtgaattcgctatcgtggatggctatttattaatccgtttcatgatcgaggacaagagccgtttcgcctatatgatgcctgtcggggatggagatttagcgggtgccgttcgtttgctggaagaggattccttaaaatatggacatccgctctgtatgctgggtatcacccccgacgccaaggagcaactggaaggcgcacttcccggaagctttttttatatcccagaacgggattatttcgattacatttatttacgggaggatttagcgaccttacggggtaagaaataccaatccaaacgtaatcatatcaataatttcaagaaacaatattcgtacgagtatgtccctatcacgccggatatcgtcccccaatgcctaaaactggaatgtaaatggtataaggcgaacaatggagataatgacgaggaagagcttaatgacgaacgtcgctcccttacctatgccttgcatcattttgacagcctaggcctgatcggtggcgctctccgggtggataacgagattatcgctttctctttcggggcccccatcaaccataatacattcggagtacacgtggaaaaagcggacgtgaattttgacggtgcctatacggtgatcaaccaagagttcgcctctcaccttccggaacagtatacttacgtgaaccgggaggaggatctcggcataccggggttgcgccaagcgaagctttcttatcagcctaccatactattagagaagagtgccgcaataaaaaagcaacttacgcaaactaaataaattatggacaagaaacaacaaatcgtaaacttatggcgtacctgcttcggggattccgaggcatttatcagcctttattttgatcgtgtttacaaggacgagaacgcaatgaccatcgagaaggacggtaaaatagtttctgccttgcagatagttcctcatacgatgacttatttgggtaccgagatctcggtaggctatatctctggggcgtgcacgactccggaagaaagagggcaagggcttatgcgacaactcttgcaagagacattcgaggaaatggaacggcgtgagatcgctatctccgccttaatccctgccgatccttggttattcgactattatagggaacagggttataccgaggcattcgattattccgtagagacatatatccgcccgaatacgccggttcaactcccgaagataacggttatccaaccggaggtaccgacaaccgacgaattgttcgcttatttcaaccgcaaattacgtgaacgcccttcctgtatcttgcactcgcaggatgatttcatcacgatacttcgtgatctgcaattagataacggggggatgtacacggccttggacgagaacgagaaggtggttggcatggctttcgcactgcctcttgaggcgggtacagcgccgtccgacaaaaagctttttatcaaggaacttctttacgactcggaagagatcaaggaattactattgcaagagcttaccctgcaaaataacatatcgcaagcgacggtcaatacccctcccacccctccgggtaccttacctatgggtatggcccgcatcatcgacacgaaacgcatgatccacctctggctatccaaacaacacgaaagccctgtctccaaaaaagatttggaacaaatggataaccaaacgctaacacgacagttgatgggttatcaggggaggatggcttatatgagtttgatgctggattaatagaaatgaaaaacggattgctaaggataaagttcccgcaatccgtttttattcttaaatctatttactgtttacgacaaataaaattatcatttagatgctatgatcacttatctttagcagaatctccttggtaaagaagatcattgacacctaaagtataccaatccaaaacatcttttcctccagacttggcccaattcataaattgaggatatgcatccataatagaaataccttctctaggatatgaatcaaaagatgatttagggatcatcaatccccacatcatattattaaattcctctgttgaattatcaatattctcattatacttatatcgataatattcatcacttgttaaggccgtggctgcttgttccgtccctaaaaaaccagctatatggacctcgttctttttattcttattaggatcaccccaaacaataaaaacgtttaagttgttagcattcacaactccgctcatgccattcacatctacttctatcaagctttcacgtgcttcacaagtcttattatatgtatttattatttgacctggctcgctattcatgaactcatgcgcctcttttccttccaataaattaataaccttgtctgttccttggatcttcgcaaaagcatataaagatttcgttgcacctacagccctaacacttgttgataaatatacagtttttgcattaataccttcactgctagcctctgtcgtattcatgatgctgacaatcataaccaagtcattcatatcatagtcaccaaaattaggccaattgtcttcaaataaatagacataagcttctgtcttatcatattcaggtttatactcaggcgtctcggattcgtctgtaaaaggctcatctttactgtaattgatatcgccaaaacaatcaccggatatatttacagggcatttattgccaaccactcttaacgcaccattcttattagctgaataatttacttcactttgcgcataagtatataaatcactccagaaaaagcctgttatctgaacagatgtataatccaatacaccattcaccttaaacaatttggcactatttccatctccatattgattggcatccgcatcctctacaactaaggatacaggacctgtttgagcaggattcaacgcatctgtctcaaacaaggaatgttccgccatcgatattttcgtatcataaccatatataaaattcccggaaattacagaagaaccccgatttaaatataatccggaagcagatccatcaaaagagaaagtaccaacctttaccaaacaatgattatgaagttcacctccattcaaatgcattgagtttacagtaatttccgaattcgtatgattataaattgaactatgtggcgaaggtagagtttctattctattaatatctactttacccatattaaccaattgagaatttccatcaattttcagaacagccttagagccaattatctgacctccatgaaaaactacaatttgactgttttttgtcaatggtgaggctgaagaagctaaatccaaggtagcgccgctaaaaatataaagagtgtagttctcgttatcagggaaaacgacattgttgacctttccgctcgtaattttataactcttatttttatcaagagtcataccactccgtagctctattacatctttcatctcagcttttttatccaacttctcaatttccttctccgaaagcggggtgagccaacgtgttatttcttgatcactaatcccgctgtcactacgcaaaaaagattttgtaataactggatccgtataatccaataataaatcgccatctttcacctctaagcttacaacagtactatacccttgtgcatccgttttcttaatataaatatattcttgagtcttaggtaaagccaaatcaacaataaatggattccttgagtttgttttacctccaacatagaaaacagaattaggatcagtgatagggtccgaaccaaatacttctatcgtataataacgtttcccctcatattcatccaagactttaacagtcaatttatggctagcctttgttgaataatcaaaatcattcggaataccatttgtactctcgtccggtctcggctttggatcgggatccggcttaggctcgtacacgtccgctgtacatgcggtcatcagcaccgcaaacaggaacagtgccatgaactttactttcgtaaaaatacatctcttcatatgcttaatcattaaatatttcccctataacatcattaaaaaaagaagttgtatattttaatcaacttattgagtattatcaacagcaaaggtagattttattataatgcgaagttcttaaacgcacaaatattatcacatcaattaactataattaataatactccaaagaaaaaacctttgataaatagacaatatttattccatgtcatgttaaaaaagaataataaaagactattcaccctactccaaccattcaatcagcttatcagccaaagttactgttcccggcaaaggtggttggtgccgatgtggagaaagcccctagcgattttctcttggcaataacataccatctggcaatttgacaaaatgaaaactaaagtctcggagaatcgattttttcgggcaaaggtacggctcgtttctaaatacgagaagaaaaagcagcatttgtctcgttgacagatgaatacagaaaaacagcctctcgctccagcgaaattaattcatcgtatctcatattttgaggcaagaaaagggtaaaagcagtgttacgatagggttatagcacggtaagaatgcccattcatgagtactcataaccctatgcgtgaccgctcataatgcctaacgcgagtatcggcattgggcaatacgacctatcgcaacaggtttcgccacctatcgtgtacaaaattggcccctttttcaagaaaaagcgtgtttattgccacacctatctcattatcttgtcactttcgcacgaagggtatgtcaacatattcgtataatatgaagcaaatagtcagaataagcttctatttcgcaacagacccatcatacaagccagaggctcccaataggccttaagcactcacataaaacacggaattttcaatccaactgataaatcttcagcttattgtaaagcgtcttccggtcgatgcccaataactgggccgcacgggtcttattgttgccgcactcttggagggccttacggataaggtctcgttcgtgctccacgttctttagctggatgttagtgtgcgacgggaggttctccgtcagttcctccgggagttccttgcgggtgatgtagcggccggtcgccaataaggtggcgtacttgatgacgttcttcatctgccgcaggttgcccggccaagaataggattggaacaattgcatggtatcgttgtcgaaaccgatgatatctttctggagctcgctattcgccagatcgagaaaatgattggcgaacaagagcaaatcctcttttcgctctttcaagtccgggatacggatcgtgaactcattgatacgatggtacaggtcctcacggaaatctcctttctcgatcgcctgccgcaagttctcgttcgtagcggatatcagacgtacgttgatggcgatctcctgattgctcccgatcggcttcaccttgcgctcctgcagggcacgcaatagctggacctgcacctcatacgtcaggttcccgatctcatccaaaaatatcgtaccgccttgggccgccacgaacgccccggtcttgttctcgatcgcccccgtaaaagaacctttcacgtggccgaagaactcggaagccgccaattccttgggaatagcgccgcaatccacggcgacaaacggagccttgctacgattactttgctcgtgaatccgacgggcgatatactccttaccggtaccactagcgccggtcaccaataccgacatatccgtcggagccaccaaacgcacatgctcataaagctggcgggccgcttggctctgcccctcgatataaagatccggggccgaagaaaccgggactctcgccggagccttctcctccacgcgcacaagttccttgatctttcccagcaactcatccgggttcagcggcttggcaatataatccgccgctcccagcttcatcgcctgaaccgccgtttgtatctccgcataactggtcatcatgataaggggtaaggaaggatgagtgcttttcagccatttcaataagtcgatcccgtcactatccggcaggcgtaaatccgatataaccaaatcgaacgcttcctcccccagcctccgtttagcatcggaaacagaggacgaggatcttacgacaaaccctttcttacccagccatgtggtaagcatcaaggaaaaagttatatcatcttcaacgattagaatcgacaacatacccactcagattatttatagtaaccacaaaggtaaataaataaaacgaatcaagaaaacatccacgtagctttacgccatactccctcgaaaggaccttgtttatgatgggctaaccaccagtggcaaaaacctagctggagaatgaaaagaaggattcctacggcgaagctggcggtcgttcccagatcgtcatacagggataaaccgtatccgaaatagataaaagagcctaccatcgattgcgtgaggtaattcgtcaagctcattttcccgtaaggcacaagcccgtgaagcaccttatgcggcgccttccactgccacaaaaagataaaggaggataccaatacgcacatgaacgagaaattacgcaaggaagacacgatcgtactcatcgggcgaagctcttcggtacgctccagcaaaccgggtagggaaagggacagataatagaggggaatgaaacaaactaccccgataacaaaggtccttgtccaaaacgtccgatgcttctccggatcgacaaacaatcccttgcgccccaacaacatgcccagcataaagagagccgatgtctggaagaaacgtccatagctccaagcccagagaaggctatacagctgcccgtcccacagattagacttgaccatttcccaaaagctagcaccttccatatacggatagatccgcatacagtgcaccagccattgttccttggatgccacatattccggatgcatcaaggcatacatgaatttaccccattccatgggctgtagcatcaaaaacacggcgatcgccaataccatcttattactcaacttgcaaaccggtatcaacacaatacccaagatcgaataaagcaccaatatctcccccgggaagaacgaggcgttgaagcaaccgataaagaataggagcatcaaccgccagaagaaacgaagccggaagtccttccctttcctcgcttggttatcaaactggatgaaaaaactaaaaccgaacagcagggcgaaaatagcgtatgccttcccggaaaagaggaagaacaaggtatcccatacccctttatccaaggctttcataaaatcggtagtagcctccggaaaattatacaagttaaaatgctcgatattatgcaataggataatagccataacagcaaatcctcgtaatgcgtcgaccacctcgatacgaggtcgggattgtagcgcgtgttccatgatatgattcagtagattttattatttcgtggcaaaagtaacgaaactaaatagaaaaagcatcctcgaaaggatgcctttttcttttgcagacttaaattgaatactcaggacttaatctttcgccatgaataaattcatgacttttgtttttaacggtttaaatgtagaaacgcccacttgcgatttcattaaatagatagcgaatatcgtgccaaagccagcgaaacgcacgacaatgaatatctaactacttatcctttaacaagtaatagataaattttgtttctataaagtagaattttatttcaaaagcatggggaaaggcattccacggatgggtatttattccacaccggattccacaagattacccgatggcggactccgcatccttcacgatagcaagtgcttgctcgattacctcgcccagcaggtggtaccagccggaatcggtcagttcctcatcgttcttctccaagatccgcaggtgttgtaccaatgaattggcccccagcatcgtgaacaggggaatcaacttatgagatatccgggaggcttcctcccggtcttttccctctaacgcatcccgaagtaagtcgatgctcttgcgggtttcctccgagaaggttttcagtatagaggctgaggcctccggatcctctccggcaaaagcggtcaacgaagagaaattcaactcgctccttgcctccagatggagtgtcagcaactcattcagcaaggagattaattgggcggcggtaaacggcttgttcaagaaacccgtgaaaccagcctccagataatgctcgtgctccttggcgatactggcagatagggcgatcaccgggatctcatccgttccggggataccggacgtacgtatccgctccagtaaatgatagccatccagcgtcggcatctgtatatcggtgataatggcgttgaatacggtgttccgcaatagctcgaggacgttatgcggattcgtacaacctaccacctgcacgtgactctgcttcaagagttcctccgtcaaggccagttgtagaggatcgtcatctaccagaagacaatagacatcttgcccctcaaacaagggtaaagcctcggcctcaccagcatccggagcctccgccgttacgtccggcaaagattgattatcggccaagggaagaggtagcaagatcgtgaaatcactgcctttccccggggtactatccaaagcaagcgtaccgttcatcaaggacagaagcttacgggtgatggagaggcccagaccgaaaccttccacctcttccgtatcggcaaggcgagtaaactccccgaatatccgctcttgttcctctttcgggatgcccggaccggaatcgctgacggtaatggacagttgataatggacagcggacagtttctgtaaggagacaagtaaaacgactcgccccgcttccgtgaacttgatagcgttagataagaggtttcctacgacctgccggatacggatcgggtcgcccatataaacttgcccagtctcctccggtttcaggttcaagacaaaccgtaagcctttcgcctccgctatcggctggaagctggtatagatctcatcgaacaaggccgggacacggaagggaacgctatgcacctccatctcgccggactccaaccgctggaaatccaacaggtcgttcaccaaggaaaggatatgatccgaggaacctttcatgttctccagataatattgctgacgctcgtctggatggcggcgtagcaaaagctcgatatatccgatgatggaagagagcggagcccgtatatcgtggctgatcgtcaacatcagcttctcacggcttcgcaataagctctcggcgacctgtttcgccttttccagttgcatacggtaatatttacttcgtgagatatcccgtgagataaagaagaggaacagaaaggcgattaccacggagacgatcgcgattccggcgatcaaatgggaggtctcccttaatagtacctgcttcttatagaccctttccagcgacgcctccatctcctcctcctcgatattacggagcatctggttgatctcccgggtaatcacgctattgttataccgtaagttagaggccctttccaacaactgatccatcagttgttgccgttgccaagccacactgtcttggatgcttttcagaacgctgacaatcgtatcggtcggattataagcgttcaccaacgtatcggtgacgatctcccgggtcgtgttcaccacgatgctggtatcttccttgccgggagagaacacgtcggccaaacgcttgaagaatcctcgcttcttacggggaactaccaccgtatcttgcttgacctctacccgctcttgtacctgcacctcatttacgatcgtatcccggacggcaattattttctcgatattctccgtataaagacgctccgtgttcgcttcctgccaagtctcaagcaagcggcgggtattccatcgcttacgctccagcagtatgtcgatcgtatctattttcaggagttgcatggagtccgtcaccaaggtcctcaacgaatccatgttattatgggccttattcaacgtacgattgaagtggcggaactcgttctggggcatgcctaccaactgccccaacgcctcgctctcatagagcagggagagcgtattggtgaccaagtacaccttccggcgtgcctgatgatccggctcgtcctcctcggccactttctctactatattataaatgtaagcgaccgagcagaccgcaatggtaatcagcaaaatatagcctaatatcaccttgctagtaatatgtccgctttgctctttcatatacgattgagatcagtctaattcctatcataagcgatatcccatttatccatcatctcaaaatcctgcttttttaagccgactttccaaaatgggatcgggtcgtcatggtctcccagatacatacggtcacgtaccttgaaggcacgattcgttaaagcaaacgtggaatcggccaccggagtccgcacaccggctatatcaagcatcgtatggaatacgctgttcgtgctaaccggataagtctcgtgtgcctgcgcttccagatatttctggggatatgactcccggtaagccttcgagaaccagatcacatacgggatatgcaactggtaataggtcggtatcggagaagcatgcagataacgggctctggaatcatcgaagatatcctctccatgatcgcttaagtaaagcatggatgccggagcatttgtcttcgccaacatatccacgatttcccccagcacgtaatctgtatagtggatggaattatcataagcgttccgtaactcctttttatacgaggcacgaattccctccgccttatccggcctatagaaacggaactccttcggataacgttcatggtaattaaaatgcgagccataagtatgcagtactacgaaaagattaccgtcctctttatccagttccttctttagataaggcaggatcgccgcatcgtgcaaggaggttagcgtagaacccgtattaaatgcgctcatatcgataaaggtatctgcctcccggtaaaaagcgccgatcatcgaggtcgttagtttctggttggcgatcacgagcgtacggaaaccagcctctttgaaagcggtcacgatacttttctcgtcgtaaaggactccataattctcggcgctggcagcggacaggataatggggacacttttatgcgtattattcgattgcgtcaccacatccgtgaaatgcaccaatccgtctaaagcctccatacggggagtcgtcttgcgctcgtatccgtaaaggctccattccatagcacgggaggtctctcccactaccaagacgtagatctcccgttttccctcagcttgttccagcttagtggcgtcgaacttaaagtcggcggaagtaatatgatacttacggttcctctccgccttatttatggcgaaatataaattgtatagggcgttagccggatacacatcgtccttccatgagaaccggtgatcttgcaaaggagacaggaagcaaaggatcaagcccatgacaaacatgcctaggctgatcttggcccatttcttccggaaagaatttcgcaatttctctttctgccgtatcgaacgataagcgagcaccagcgtaggcaatgtatagaaaaagaatacgcaaccgatcaccagaatgatattccccaataattcgctagcctcggaagcgttcgagctggtaaggttcaaatacatatcaaccgctatcacggactgcccgaaaagatacagaagcaccaactgccccccgtctaatataaccttcggcaacaggcaccaaaccacgatccccggtttacgggccactaacaaaacacccatccaaaaggccaaaggtatcagcaacgaggcgataccgaccgtaacgggaagcggttccgtaaaaaagaacacacagtttgggatgataaataacagggcaaataagaaatataaatgctcctgtgaggatatccagcgtattaactttgtaaaatacttcattcaataaaactttgccaactctcaatcattactcttctcaaagaatacccagaacctaaaattccggtaattggcaaagataggcgttattaaacacatacaaagcgtattatacacaaaaaatgttattcacagtcattacttctccttcatccgtcgccaatactccttgacagagtttttcacttccctatgtaacagcaagataccaattaagttcgggagagtcatcaaagccacggtgataccggataatgtcaatactaccacacaataaaattatatttatctcctatattttctggaggatagcgataaactcatcattcgtaatgtctagctccggctctttgtaattgacataatcctcaaaatagtcgctggcgatatcggctacgatctcccctccgtccaagccatacgaggaaactagtttctccacccggttacgtatctggcgaatcacctgtaaacgatcctcataacgatctggcttctcctgatcagtgacgtgctcattccgggcgatcaagtaaactaccgtataaaatttctccatgctcccgaaaacagggacaaacaaggatttcttctcctcgggcagatctgccaaaaactgttgtatctttgtcatagctcttactcttttacctaataaaaaaaacaatatactttttgttctaaaacaatatactttcgtgtgtaaaagtatattgtttcgacaacaaaagtatattgttcttctcgagtctgttaaatgattgaattcttcttcgtaaaatccaaaatctcatcaatatagccaaaagccaatcctgttaccgtatctgcgcagccgtaatagatagcgatacgtttcgtctccggatcatgcaaggcggcacagggaaagactacgttcggaacgtctcccatgcactcgtaatccttttgcggggataacaaataaggtccggagcggaatttcactttccaaggttgctccaaatccaagatagcggaaccgaagctatacacatacccgttgcaagaacgaagcacgccgtggtaaatcaataaccagccttcggaagtctcgatagggatagggcccgcaccgatcttcgtacactgccaagcgctatcctcgaacgcagccggagacatcacgtggcgatgtttaccccagaaacacatatccggagactcgctatagaaaatatcgccgaacggagtatgaccgttgtcgctcggacggctcaacatggcgaagtttccgttaatcttacgagggaacatcacgccattacggttgaaaggcagataagcgttctccagctgatggaaggtctcgaaatcgaacgtgtaagccacgccgatcgtcgggccatgataaccgttacaccaagtcacatagtaacgatcctcgataaaacatacacgggggtcgtaggcataaacaaactcgccgatctccttgtcgtcgcactcaaactcgagttttgtctcagagatactccaatgaatggcatctgcgctaaaacctacgtgcaaacgcatccggcgattcgtatcgtcgcatcggaacacaccggcataaccacctttgaaagggacaacagcactgttgaacacactgttcgatgtcgggaggatatcacgaggaatcaccgggttcttcgaatatctccacaatacttctttgctaccctcgggacgatcttcccaaggcatatctggcagcggagcgcctacgattttcaaattatccataactaatcctattaaaatattactatactaacttattacctttatcgtcatacgtgaacggtacgaaataggctaccaagaatgaagggatcatcgccagcaaggtcacgataaagaaatacttataacctagccagtcactcacaaaaccgctcatcattcccggaagcattacgccaaggttcatgatacctgaggcgaacgcataatgcgccatctgatgcttgcccggagctacctgttgcatcataaacagcatcaagcccacgaaaccgaatccatagccaaaatactcgaatacgatggcggaagcgataatgagaccattatcaggctggaaacacgccaagaacgtgtataccaaaaacggtatgttgaagcaacaacaaagcgtaaacaatacctttcgcaatcccttagccgagatataatatccaccgagcaaagaacccagcacaaacgccgccgctccaaacgtaccataatacaaaccgatctcttgctccgttagtcctaatccttgatcagctatcggagctttcaagaacaaaggtacgatctttatcacgaaaccctcggcaaaacgatacaatataatgaaacagatataccacacgatatacttcttcgtgaagaactccttgaagaccagccatagctcagccatactttccttcaacgaatgttctccggtagcggcttttccacccgaaggcaacatcttcatatgataaaaaccaagcaggatcatgatcgtaccgcaaagcagcataacgatcatccaagcgtatatcatggcctctttctccaatcctatcccggtaaaatattgcatcatataacccgccagataaaccagaccacccgtggctacgatcttcgctaaattgtaaaacgcaccttgccaaccgatatatttggcttgattctccggtgagagctctttcatataaacgccatccgttgccacgtcatgcgtagccccgctaagcgctataatacctaataatgcgatagatagagcaaagaaactcggcaagtttaacgccaaggccactaaaccgaataagcaaccggataacaactgggtcaatacgacaaagaatttcttggtacgatacatttccaaaaacgggctccataaaggctttaaggtccaaggtaacatgataaccgaggtccataacgcaatctgggcatccgagatatccaatcccttaaacatgagtacggtaaccatgttcagcactacaaaaggcaatcccatagcaaaatagacactagggacccaagttacagggtttcgacgtttagtagcattcgtgtttttctcttccatgctttatttagaatttaggtgtacaaatataattaataatccggatatatctttaatcgatcggacaaatagaggagatcatcccgaaggtagcgttatcattcaaatcccagaccatctttccggctccgtttatctcgatcaactgcgggtaatgtcctttcgcagcctctccgtcatggccttgccagttacagatatacaaaccaccgtcccgtttagggagcaactgggcaacaaagaaaagctgggctccctcgatatcgttctcattcaccttgcgaacgatatctccagtctcgaaattcagctctatgaagcaatgggcatcaccgcaagcgaccagataattaccgttatccaacgcagccacgctaaacgggttaccgtctactttcacgcttttcagcaattgaccagacggggatatttcccggatctcagaggtagcgaacaagggcactaaataattgccctgcttattcttgtttacttgacggaattgggcatggggttgctcgatatgggtgtcgaaatccgttttcgacaggatctctccttttgcattcacctccatgatcgtcgccgggtatccacaccacgctaataaataattaccgttgggaagtacacgggccgtctgcatctcacagccttccggagcggagatattccagacctcctcatgatcccgggtgattagcttcgcccctttcgaataggaaaaaaggatattccggtcgggagtaacagctacggaattacattcccatcctttttccaagggatgctcccattcaatttctttcgtgttcttgtttacgatggcgattttgtcccagccggaaccgcctaataaaagataatgcgacgcctcatgacatgcggaacatacgagtagcaggcatgcggataatataaaagtatagattttcatggtatataataatgtactaattagataatatgccaatgtgctaattatagcaggatggacacatggagtccaccctgcaaaaaaagatcatgtgtgttgtattcgcattggcatattggcacatttagcgaaacgacacattggttcattcttctttatttcgctaagtcacggaacaactcatatccctgatcgggcgtgatatcttgatgcacgaccgcatgaaccgcctggatcatggcgacaggagaagtactctggaatacattacgtcccatatccacgccagccgcaccgtcgttgatcgcattataacataattccaacgcctccttctccggtaatttcttaccaccggcaattaccacgggaaccggacaagcagcggctaccttctcgaagccctcacaatagtaggtcttcacgatattagcgccattctccgcacagatacgggaagccagaccgaaataacgagcgtctcgagccatttgcttaccaacggcggtaacacccattaccgggatattgtaacggctggccttatcgaccgccttatataagttagccacagtcttagcctcatgcgcctcatcaccgatagccaacataaccgccatggcggagacgttcatacggatagcgtcctctatatcgatcaatacattatcgttcaaatccgtaaggatagacgttccagcgtccgaacgaagacaaatcggtttcgtcgtattcgcagggatcgtagattgcaggataccacgggtacacatcaagcaatccgcatattcaatcaaaggaacgatattcaaatcgatacgctccagaccggaggtcggccccatgatgaaaccatggtcaaaagcaagcataaccgccttgcctgtcttcgggttgaagatacgggacagacggtctttcataccccaaggtaagttctcggctccctttacatggaaactctggttctcacaattgatgcctaaaccgaagtccgcaccttctcttaaatcatctaaatctgccatatttattattcgttatattattatattttgtagagacggggcatgccccgtctcacgctgtgtattattttatagcacctctgcaaaagaagcgaacatacagctccacgaagtagccccgctatcagcgaaaccaatcgaacgctcgccatagttgcgggcacgtccaaagttagctttcatcggtaccgtagcctccgctccatcaagcgccgctttagcgccggcattcaagacctccttgatatcatccgacgtacaagcctgcatagcctccaccgccgggatcaaggcatccatcatcgtcttgtcgcctcgtttcgcttgggtttgttgttgcacattcgccaagccaccggcgaacataactttcacgcctgcggcatccaactcggttccctctgcatgatcgctcatacccaagaagaaagcaccgagcaaggtacttgtcgatccactcacttccatcatcacatccatacccatatcaccaagcatttgcttgaactccgttccagactgagcgcttttattcacagcagtcatagcggcaacgatagcggtaccatgatcaccatccccgattacggcatccaatttagagaattcctcctcacgtgccttgatctgtttcagcgcattgtctaacatggccttgaaggcctcgatagtaagttgtttcatgtatattatttatttacctagggttgtccaataaggtgcgtccgcacgtttgttattcaaataatcgatatgatcctcatccaagatcgccataatcatctggaatccggcttgctcctgtacggtcaagatctcttggatacggcttgccaccacctgcaagccgcgagcctctaactccttataagccttgcggaagatgatattcaattccatatgggtagtagcgcctacgccgttaatgatcagcaacatcttatcgccggcttttggctgtaactgctggcaaagcaggtctaccatctccgcagccgtatcatcggcggataccaacggtttctgtccaccgccaccttcgccatgttggcccataccgatctccatgataccatcgggaaggttcgtgatcgtacctccgttctggggatgcgtacaagaccgcatagcgacagccaaggtagccacgttcttattatagcgttcaccaatctcaatcagctcgtctaaagacttcccttcctcagcggcggcacctaatatcttatacaaaggaacacaaccagccaagccacgacgatcgtctatattcgccccgatacctgcgctgatatcatcatgcgtaagtaatttcttcaccttgatccctttacgagcagccaactggcaagccatgttagcgctcatcacgtcgccggaatggttcaatacgaccagcaagatcccggcctcacgatccatcaattgcagtgcctgaaacaaacgttgggcacccggagcggcgaatacgtcacccacgacggagcaatccaacatgccctctcctacgaaaccgctcaaggcaggctcatgaccggaaccgcctaaggtaacgatcgcaaccttatcattgcctttcgggttagcacgtacgacgatattctcagccgccaactttacctgattcggatacgctaatacatagccttccaataactcagccgtaatattctcaggatcatttatgaattttgtcttgatgtctgacatggtattatcctcctttagatttatgaattttgatttacgaattactttagttccatgatctcgatagcgataccttcttcctcgatgaaagcgatcgtcaagtgctcgtcgcaaacagccgggccgaagattaccttcttaccttccaactctttttccaaacaaggaaccgtataagcgatgtggccattggtctgtaccaactccggtaggcagctgcctttctcgaatttcaagaactcgatccggttcggactcttgctgtaatccgtcaaccatacactcaggccttcgttataaaccgccccttctttactttccgtagtgacaattcctacgtgattaaatgttctcatgatctattcaatttatagttagacaattatattattaaaattcgttctcttccgataggatataaagccagcccccaatactaggatgatcgacagataaagataaataaatatcccgttcacgttgtcattctggccataagagtgcatgccactcaagaaataattcacgccgaagaaggtcatcaacaccgaatagaaggccaagatagacgtgaaattaaacagccacaggttattgcatttcggtatcaagcgaagatgcgtcacgatcgcatatatcaccatcgtaatcaatgcccacgtctccttcgggtcccagccccaataacgtccccatgactcattcgcccagaccgctcccaagaaggtaccgatcgtcatcaaggccaacccgatccaaagcgacatctcgttcacgatactcaattcccgtacccgctctttgagcatcacgctgttcttctccccgcttacgctcatcatcaccagattcgtcaagccgatcagacagctaatgccgaagaaaccgtaagctcccacgataaccgccacatggaacatcaaccacggggatttcaagaccggaaccagcggattgatctgcgggtccatccaacttaagccggacacgaacaagatgatccccccgaataatgttgccaacgcaaacgtaagcgtactctttcgtacgaacaacaacccggcgaacaccgtagcccaagccacataaaccatcgtctcgtacgaattgctccaaggagcgtaacctgcgatataccaccgcattcccattccatacatatggaaaacgaatacggccaaaatgcccagactcaatacccaagtcgtataggtaacccatttttccttcttgaataaggccacgaaagcgaagaccagcaacaagccacccaaaatcaagtagcctttcttacattgccggaatacatccatttgattatatttaatctcggcctgtattttctcagggcgaatgtctaccgtcttattcttggcttgctgatacgtatggatcattccgattacctcgtccgctttctcccaatcaccactcttcaatccttcctgtacctccgataaataccagcccataatgtgggtaacgaacatggagtcctttccggaaaacgccgacaaatcatcgcccggcgcataccatttgtgatccgggtcgtcctctttcgggaaaaggtttaacatctggtaattgatcaattgatggaagatattcacctgctcatccagcttgatcaagtctttatcgaagcgggtacgctccgccggcattttattgtaggcctcgtccagcttctcttgcaatttatagcgtccgtggctatcgaatacctctatataggcacactccttatccgtaaggtcgtaataattagccagctcactattagacaaggcgataaacggcacccggacccacatatccggcatagccaagacgctcaacaagaactgatcagagttcaaggaaccgaaccggtctgatttatgcaacttccgtagtacctcggaagaaaatgtattgattggcaacatacgtccgcttaccgattggatcggcaacgcaccgaacttagcggcatgttccggacttatcgcatatttctgtatggcctccttcatctcgggagcggccgcaccttgcgcccgcaagccccctacggaaagaagaaccgctactaacagggtcgttttacgagcgccctctcttaaatctttcaactgacggcttaatttcatgaaacgggagtttttacctaccaagcaaagtataaagccgatcactaaaatcacgtaaccggtatatgtaatattccttccggccacatctcggttcacggaaagtaccgttccttgctcatccgggtcataggaggcttggaagaagcgatagcctttcacgtctaatacattattcatatatacccgggcatggcgagtctgtccatctacatgtaccagcaactcactctcataagcagagggactggcagagccgggatagcgggttaaggtaaatttcacgagttctacgctaaaaggaagcgtatgatagagagtctggtccgaggtacggatcatgatacgatcgctagcctctccctcacgcaggtgaaggattccttcctcgccgaaaaggtgggaaataagggcacccagaaggatgacaataaaggcggcatgggtgaccatcaatccccatttacgccgcttaagtaactggtgcttgataacgatagccacgaaattggctaccaataagaattggagtaagaaaaatacaggagaatagtaaatcagcgctttagcgacggcagtaccatgatacttctctataaaagtagcgatagccaagccaaaggcgtagatcaatagaaggacgatagtcgtcacagaagaagagataaatctttctagaattttcatttgctcatttattaataacactgatgcgacaaatgtacgcagattaatcatttttgaaagaatcggcgattaatttgccgcatccatgttatctatctataaatagaccttgtctattaatcctcaataattacccggaagcctacgttgaatacacgttggtacggataatatcctttacgggtataagccgtcgagaatttcggtcgctcgatataagaaccaccacgaaccaccttatactcggagacctctttcgatttctcgttgtaaggataaggcaagtaatctgaacgagtccattccgccacgttaccgtgcatgcaatacaaaccgaacggattcgcttcatattgcttaccacccacctggaccaaattgccatcatccacgccttcctctttcggtaagtaagtatagtacttgtaccaataagaagtcttaggcatcggttgcgggtcgataccgcttacggcaagcaggagcgtggttacgtcggctaggttatcctttttaccgaagtccgcattcatatcgccataccagaaatcttgatcgctaccggcacgacaagcccattcccattgcgcctcggtcggaagcgtgatgttcaagcctgttttctcactcagcttcttacaataatccatagcgtcattgtaacttacacggattaccggttgctctggcttattagcgggatatccttgaaccacgtgatccttccattgctgatccacgaaacggctgtcgtgatccgggaaaatcacgttgaattgctggttcgtaacctccaactcacccatccagaaagctttgtcaatcttcactttcgccgtcggacgagtatcggattgcccacgatagctacccatcacgaattgtccggccggaatgcgaacaaatgtcatcttgatacccggagccaactcaatctccttacgggtttccttctcgtcggccaacatagccttgatccggtccgcatcaaatggccaacctttcaccttcaactctttttccttgacaggagccaatttctccggcatctccggtttgatctcacctttacccttcaagtaagcggcataatcggagatctctttcttccaatccacgcctgcgccattcgcatacttatccgtcaactctttacgacgcttgatctggtcgaagccttgatacgggatgatatccttcgaaagtacattcgcattgaaataacccttatccggagcgttgtaatcaatccagttataaagggttttccactctttatccgtcagttgcacgttaaagtgccctttcttcaacatacgaaccagttcactcgtgttcggatgatattcatacggttgaagaaccaccatatcaccctcgccaccttgacggtgtacgtacggatgcaggttcaagtaagaagtgccataacctaatttatccttcttgcccccacgcaagtcgaaagccttgccctcaccattatggcaagcgatacaagcgcgatccaagatcggttggatctccagatcgaacgtgaacgaacgggtccccccttccggcggagtcaacgcatgcggggctttctgcgaagccatcacacgtttcgggataggaatctggttctggtcctcatggcaaccgatacaagataccacctcgcccggctgaccggtcaaccagctacgcatccactggatagccactccgtctttgtctaacggctggatagagatcggcgtattcgccgggatcttgaagatagcggagccatcctcttctaccggtaccgtacccaacatacgcttgatgtcccaaccggactggattccatgccagttatgatcggaggtagtcttcacgtaagcatactcataagcgtgcagacgaagagacttaaccgtaccccggggaatgcctctcaaaccctctccctcgtaaatatcctgaataaagaccgtagcctctttgtcattcaatttcacacggtccggaatagccggaggagtctgtgtcttacgtacggcaaccggactgatatagccctcaccctctaccttacgcaaacaagtcacgttatcgaatacgtccaccaaatagataccccataaatcctgtggatctaatttagcggccaccaagaaatatttatcattcagcggagtcggtttgataaactgcggccatacgccatttaccaactcatccttaatctcctccacgatcggccggttacgatacgggatctcctgtaccataccagcggcgcctttacgggctttcgccggatcgaacacgattaaacgaccggaacgggcaataccatggtgaccggagataattcccacgaaagcggaaccgtggcccggcaacggctgaatatcgaacgtactgttcgggaacatcgatccgctaccatacagcgctttctgctccgtaccatccggattcatgttcatcacgatacgggaataatagtgcgtcaagtccgtgtactcccaacgagtgtacatcacacgaccgttattcatcactaccgggttccagtttgcgtcttgatcgaaagtcagacggcgcaagttcttcgtatccggcgtataaagtaccatattaccgacagggtcatcaccacttacacaaggcacgccttgataaccgatattcgagttggcgatgatacgtccgtccggtaagtaggttccatcataaaactccagatccggttcctcgttatgtattaattgcttaaagcccgagccatccaatttcacctcgaatacgttccaacgcttatcgggcatcgtctgggtaaacatagcacgatcgccatcccaatgcatccgcaagtcggcgacagaggaaccgttttccggtttatagatcgaccgtacctgtacatcctccccgcgtaaattactcaactccacgatatcggcgtcgaagcccatacggcgggcggactcttggttactccagttattaccctgcgtacccaaatccggagccattgccttatgagcgtttacacctaatttaaagcgggcagccaagactttatcaccgtccaagaacgggttcgccagcaagatcgtacgtttattcgcaatcgctttctcggcattaaccaaagcggcctcatcaccactataaatgccatcgaaacctttctttacctgctgttccaactcatccagaaccggttgatatttagtggcgtcgaagcctttcaactttttcatatcgttgaaagccaaacgaatcgcctccatattcaaccaactcaagtcgctctgcaaattacagatacgttgagttttctcataaagtttcaaatactcacggatctgagtatcaatatctttttccgtctctatctgcttaacagcgttctttacatacgcagcgtctttcagacgagaagccagattcaagacaatatcacgctcggcggaagcgtcactggcggtcaaccagttctccaacccatcgatattagcgtttaaagcccccaattccttcggataagcggctagcaaacgtgcggcctcctccttcgggaaaacattcatgatacggaagaatacactacctaccgtcgactgatcggccaaacccacctcagcctcaaagcgtacatattccttattgatattgtacaccatcacgccattggcatggcataatacgctatgatcgtatttcttaccgccgatcaacaaaggattcccgtataaatccgtattcttacggatactgtttgaaccggaaacccaataatccgggtctaactcatccaaccaaaccgaactaccgtccgccttgattaaacgggcattcgcccatgtaccccaatcccaatccgtaccgtccggtccggcggccgtaacaagtaccaactgatcctgccccgtcaaatcggcggacatcgggacagccttctgcttcgctttgatccaagcggacatgatcggcatgttcgccttcaccaaagaggcacgaagctcagacttttgttttactgaggcgtcaatccagttatccaccttcttttgcttcggacctgccgaaacaagaagagaggtcgacaacaagagtgataccattatatagtatttattcatgtattaaatttaaatttagaaggttgtttattgaaaccctaaggatcacgatcggcaacccttagaattacgaagcataaccctagaggtttttataaagcggccttctggttcgtgaaacgtaagccagcgttgtcgtgatagcatgcccactcatctacgatagcgccttccggacctgccatcataaagtggaatgtctccaatttcttcagacgtaatacgtcgccgaccttctgaaccacgaaattcttgctcttgatcggtccgtgtccagcagggatagccggtgcgttcggagtctcgtcacctacctcagagaagttgtatacccaacccttctctaccatccaagactcatgtttagccgggaagtcagtctttacgtgagcatgttccggaatcatctggcccggcaacaaatagatagcgtgagcgaaatacttatactccggatcgttgatccagaaaataccccccatacctacattctcgaaatcgcccaagccaaagtctgtcacccacatatctttcgccatcaactccgtgaaaggaacatcgtagaaagcaaacatatctttcatcgcttccatagcgacatcttgttgaaacttgccgtctttataaaaatcggcgttcgtgtacttctttgaataagccattgttttatttttttgattgttagtattacatgcgttcgtgcattctttgcggcaagttccttccggacaattgccctccccgttagcggcgcaacaagtagcgtctgtcgttgtctttcccgtacatgcgaccatagataccaacaccaatcccatagccgccattttcatgttcaaaccttttctcatttgtttttgtgtatatttgttagtactatttgtttcaacgtatcgctattccctcgatctcgatcaataactcatcccggcaaacgtcggcccacatataagagatcgggatatttaatccgtaggtattcatcaaacgctcagcctccttatagtcggatttattcttcaagtagactcgtaacttaaccaatttagcgtcagcgatcagttccgctatattttccatcgtgatccgtagctgacgttccagacctactcccgtcaagctctcctcaccacggatagcggctgtaccggaaatataaatcaatttacgatcctgaaaagtcatgctcttggcacgctcgaacttaggggtcgtcttcttttgtcgggcaacttccagtacttgttccgaatacgcatgggcagccacctgcaacttattatcgatcggcgtagcgaaagcatccggcgtagtaaacacggcggcatccacatcgatcaagatacctcccagattcgccccgatacccgtagcggcaggataaccattcgcccattccgttttactataaaaatcagaccgggcgttattaaacgcttgataatgctgatccggaccgtcgaaagcggttatacgctcgatataattccactgacggataatgctattcaacggaaaaccctcccgacgaagcacatcccccaataaccggaaagcttccaccgacagaggctctataccaaaatggagtacatccccttgaaaaccgccggcaaaaaggaaacgtcccgaggcattctccaacaagacataaggaacaccttgataatgacggaaagtaatccgatcctgcgcatcgggcacatagctatgtacctccatcagcaaaggagcgttcagcggcggttgggagacatagctcaaagccggttcgcaatccccataataccgacggatcttctcccgcagcaaaacccggcgtgccacgtattcctcatttgtacccggagtaccgaaaaaggccaacctcatgatcacctcgttttgaggcaattgagacaatagatcgtccaccataacggcgaactcggcccgcttggtgcttaatatcgtataatgtatcttctcacaataattcatatccttttattttacagggagtttacatattccgttaacgcctcgatatctttcttggaaacctttttatcgatgccatgcttatggacctcgaacacctcttccatggtagccgcacgcccatcaaacagataaggagccgtacgccagacctcgatcaaagtaggtgtatcccaccctttctcaaattctatatcctcgccgatacggtgcatcttcatatccgtataataaggaccgctatgacactcgccacatttcagtttctcaaacacctttcttccctctttcgccttatccgataattccccatttactaaatacgggctaggcaccggacgcaaggatttcatataagcgtccacacatttcgccatttcctcttctggctcaaaaaactgaatgaacttaaaaccggcacgtaccgcatattctgcgctctcacgaacacccgagatcatgcttgggggagtcacatgcgaatacaacatgctcttacaattcttcgagttaccaactccatcattcatcaagtcccagttcatcccgtccgtacgggcatcccccggatggcaaccgttacaactctgccagccttgatagcaatgatttgcgtcgttaaagtatttctcgcccttgttctccggcgtttccgtacgccccggattcatgtcggtagccgtcacctccaatgtatttatatcgacggtattcaagatatcggcgaaataagtagggattatcaacttatctcccgaaaatataaaatttcggggaccgtttccttgtaaggtaactcgctcacgaagtccatacaagaaattcaagtcgtaatccagacggctcttatccttataagactcaaacttcgccaacatcgccggatgatcgatcacgctcacctcatgcgttccgctatgcgtgataaagatatgcttgtcatcgcaagcgatactccagataccggcagcgccacgatccggctcgtccaccaataccgccccaacgaattcccgcttcgccacatcgatcacgctgaaagcgctcgtgttcatccaaccttgttgaagttgggaagtaggcaccgtgaatcgtcccaagttatgagacacgtatatatatttcccgtccggcgtgatacacatcccccgtaaggcattgctaccattcgccaattggatatctttcactttcgtaaacccctccatctcgattactgatacgcaagcggccaccacatccacgtccgcccgttgtgcgggcaggaaattcgtaacaaacatatacttgccatccttgctgaataccgccgatttaggctcacgcaacactttcacgctccggactaccttacgcatcaccggatctatctcgaccaccgaattatcgaactgattacatacatatatatgtttcttatccggcccgaacatcggatgacaggctcccgatcccgtcggtatagccgcttccaccctacccgattccaaggaaagcacttgtaaacggccggtcttctcgaaggtcgtcacatacaccttatccccatccggaagcaatccggtcgggatctcatcaaacggaaacgaatgaagcaagctcttaccgtccgctgaaaagatatccagatgtctcgttcctttctgtgtcattaatagctcccccttcgcattcaatacggcatccgtagtaaagaaaggtgggttgccggctgaagcgagagaaacgcaacagccgacaagacaagccaccaatgagttttttatcaagtattttcgtgtgttcatggtatattttgtattccttattttctaaatcctagttcgttcgagatcaccccggcaatctccttgatcaccttcaccgtatttttcaccacctctttcgataagcggtctttcgggccggagatccaaatcgctccacaaggatatcccgtataattaaagatcggggcgcctacgcagatcacgccgctcagctcctcctcattatccatggcatatcccagcttaccaaccttctccaattcctccagataggcctcacgagaagtgatcgtccgggaattataccgtgtaaacgtcatgtaggacaggtaacgatctcgcaccgtcttcggcaaataagccataatcgcctttccgggagccgaacaatgcaactcaaacggctttcccggcgacaggacgaagcggaacgtatgatgtccttgcgcttgttcgataaaaatccctttctcatctcccaagacaccaaagcaagcggtctctttcacttgatcacgtaaatcacgcaaatgtggcaagacggtctctaagagattgtgttcattcaaggatctgaaaccaagggtcaataattttcgggaaagtttatagcgtttcgtgtcttcactaaaattaagatattccagccgcaccaatgtattcaaaatacggtaagccgtagtctgagatatatcgagcgccgacttaatatcttgcaatgtttctcccgccgaccgcaaggaaaggtactcaagaaccgctatgcccttctctaaattaggcactttgtagctctcatccactttttccatatttggcagcgtgttttccatatttgaaattgcatttcagatttgaaccaaatatagcagtgatgaatttaaacaagacacgaaatatgtaaaaaggtgttaagtatgttgcagagcatataaagccttaaaggaaaatgatcaattctttttgatttacaatgattttatctcttatatacatattatttacctactttcgcggaatatccttgaaagcacaaggatataagtgcattcataaacgagcaagaatacaaacatgacaagcgaaagcaaaaaagaaaagttaaataaaaacgagctattagctaattatcaatatctcatggatacgatctggactatctatttggaagacggaagcgtcgatatacttaaatattcaatgaatccggaattaattaatacaaaacaagattataccagccttgccaacattctaagaaacgacatctattctccagaccgtagtttatgggatgaaacggtttcgcttgaagctttctttagaatgatagccgaaggatgttttcataaaacatttgacttacgtttctgcaacgatcacttcggttttgaatggcacgaaacttttatcgatattcttgttaacaacgaaggtatccctgatagaatccttttatctagccgtaatatcaacgatttcagaaaagcgcaaattatagaaaccgccgtaagatcagaatatgattacgtaatctatattgaagcttcgaaaaatagctatgtcatgtatacctccggctcggagagctatagtccccctcctatcgccagctatgactatgatggagtagtcgcctcatataaccggcaatatatggcacctgagcttcacgaagaaatgactgagaaactacagatcgctcatatagaaccgatactacggaaacatggagaatatatcgtatatggcaccatgatagagaatggcgtaaaccgggaaaagaaaatgcgattcagctattacgacagggaaaagaacatatggttaatgactcgaactgatataacggaaatcaaagaagaaagaaaacaaaaaaaactgttgcaggaagctttacagagcgctaatgccgccaaccgtgccaaaactgatttcctatcccggatgagccatgacatccgcactcctatcaacgccatcgtcggtatgacagcgatagctggcctgcacatggatgaccagatgcgtatagctgattgcttaaagaaaataaccatttcctccaaactcttattaaatctgatcaatgaggtactggatatgtctaaactggaaagtgataagatcatgctgacagaagaggcattcaagatcaacgagctattagagagtttattcgtcatggtgcaaccggcctttgaagcgaaaaagcaaaagtttcagatacatgtcaccaagataaaacacgaatgccttataggtgacgtgcaacgtatacagcaagcattgttgaacatgcttacaaatgcgatcaaatatactccggaagacgggcaaatacaactaacggtagaagagaaaccttctgtctataacggttacggccagtttgaaataaccgtaacggataacggtataggaatgaaaccagaatttctggaaaaagtattcgaaccttttgagcggtcggatgacaaggccattcgcaatatccaagggactggtctcggcatggctatcagccgccatatcgcccagataatgaacggagacattcttgtggaaagtgaatatggaaaaggctccaaattcaccatgaggtttcatgtcaaactgggaagtacgaatgaatacgacaataatatattggtagacctaccagtactggtagtagatgacgatgaggtatcctgcgagatcgcttatgaaaacctccaagaattagggatgaaaccggaatgggttctttccggtgaaaaggccgtacaaaaagtaatcgacggagacacttactttgctattatcatagatttaatgatgcccggcatgaacggcatcgaaaccaccataaaaataagggaatacgtggaaccagatactccgatcatcatcatatcagcatacgattattccggttacgaatttgaggcagtaaaagctggcgtcaacggcttcataagcaagcctatcatgaaatccaagctattccatttaatgaaaaaatttgcctcagacaaaaaggaagacgagcaagtccttatcacaccgactcatatcatatcttttcccggcaaacggatactggtcgtggaagacaatgacctaaaccgcgagatagcgtatgaattgctgcaagaaacccatgcagaagtcgagacagcttgcgacggacaagaagccgttgataaagtcgccgcttcacccgaaggttattacgattttataatcatggatatacagatgcctgtaatggatggactcgaagcgacaaggcaaattcgtcatctcgaccgtcaagatatcaaagatatgcccattatagccatgtctgccaatgctttcgccgaagatgtacggctaagtctggaagccggcatgaacgaacatatcgcaaaaccgatcgagatagacaaattatatggaattatgaggaaatggttccagtaaaaaaagccggaatctcttccggccttctccaaactcaatgaatcacctttttacttcttgcaatcgcaagttgaatatgctgccaacatccaaaccaatttttcttgttccttcagatagtcactcatcaacgctaccgtagcctcatcgcccgcctccgatgccaaggaaagaagtttacgttcctcaccaatcagcaggccataggtatcgagaatatgtttcaatgcctcgtcaccacaggatacgcctgatacctcttttacacgggctactttcaggtactcgctgaacttgttctccggctcgcctcccaacatcaggatacgttccgccaactcgtcaaccttctcggcagcgttgttgtacatatcctcgaatttaccatgaagaacgaagaaaccgtgtcccttgatattccagtggaaaccacgaaggttcgtataaaatacttggtagtccgccaataattgtttcaagcttgctactacgttacttaccgctgatgcgtctaaatgaagataatctaatgttttcatactgctatttttttaattgttatactttccgttttcttatactgcaaagatatggtaaatataaacagctgtcaaacagataattcctatatacatatagatagaatctatatttaaacgatcaacaggaagacatgcgatagaacttaggtttctatttacccaatttaaacttatatcctgcggtaagagccaaggtatggtaattcgcctcgatagatcctcccttatactctttacctaacgatacatcatagccaaaattgataaagcattgttttatttccacacctacagtggaacttataccccaatcaaaagcacgaagcccttcacagggatcgtgggtataaaacttagcggattcttccgaagcgacagaccatcccccgaacattcctttatccaatacgcttacggctatataagggcctactccgacattcaaacgaatatcctcagctaatttgaacgataaattagccataatcggtaattgcaagaaatttcgtgtcaccttatttgagtaatcatacgcatatccatacggatcataagtaggtcccggcacagtccaccaataatgcccatatccatatccggggaattggtcattactatatcccctttgcgtataatacagaccggacttcagagaaagaaattccggcttcaactgatattccactcctaccccaatcttccaactcggtttccaatcaaccattggacccgccttcatcactgtcatacccgcttccggaactaccgaccactgggcttgtaccgatactacacccagcattaacaccatcgcaaatactacaactcttttcatatactttttattttgataaaataatcgaacgatatatatgaataagacatgaaacaataaaaaacccctattggcaccaacagaaaaaggccggaatcacttccgaccttctccaaacgcaatgaatcaccttttttacttcttgcaatcgcaagttaaatatgctactaacatccaaaccaacttctcttgttctttcagataatcactcatcaaagcgaccgtagcctcatctcccgccccggatgccaaggaaagaagtttacgctcctcaccgatcaaatgaccatacgtatcaagaatattctttaacgcctcgtcaccgcaggatacgcctgatacctcttttacacgggctactttcaaatactcgctgaacttgttctccggctcgcctcccaacatcaggatacgttccgccaactcgtcaaccttctcggcagcgttgttgtacatatcctcgaatttaccatgaagaacgaagaaaccgtgtcccttgatattccagtggaaaccacgaaggttcgtataaaatacttggtagtccgccaataattgtttcaggcttgctactacgttacttaccgctgatgcgtctaaatggatataatctaatgttttcataattactactttttaatttgttatactttttgtttttcttataccgcaaagatacggcaagtataagtagctgtcaaacagataatttttatatcaagatagaggaaatttattaaactattccatacaataagtatgcaaatgacatgaatacataaacaattggatactaacatttaaaaaagacgattatcattttcgaaaagcacgtacgtgtttttttgaaaagtcgtacatgtttttcggcaaacacgtacgactttttacagatactccggcgacatttactaacattgagatttctccatgcttctgcgcttcgtctatcaagctcagaatagacgagcgtgaggacaagtccatttccatcggcagtacgtcaaatccggcattgttcattgtctgggcaataatcgctgcattattcatactgtttttttccctaaaaaggttaccttcgcggaaacaagatatcgctttggaagtacaagaattattgaaactatatgccgctcacccgcaagtgacggcgctggacaccctactgaaaaacgatacgtcccgcaatatattcctaaagggactgaatggctcgggtccggcgatgacgatcgcctctctttttacgaaaggaaggggaagctatgtgtgtgtgttgaacgaccaagaggaagccggctatttctatcacgacttgatgcagcttaccgccagcaatgaggtatacttcttcccatccgcttaccggagggccatcaagtacgggcatgtcgatccggcgaacgagatcctgcgcaccgaggtactcagccggttgcaagacccggacgcctctttcgtgatcgtcacgtatccggacgccttggcggaacgagtcgtggcccgggaggtattgaaggagaataccttaaaaatcagcgtgggcgagaagctggataatatgtttgtctctgacgtgctggacgagtatggcttcgagcaggtcgattatgtatatgagccggggcagtacgccctccggggcagtatcctcgacgttttctctttctcctacgagttcccctaccgtatcgactttttcggcgacgaggtggagaccatccgtacgttcgacgtggagacgcaactcagcaaggagaaactggacagcatctatatcgtcccggagatgagcaagaacgccaaggatagtacttccttgctaggttccctcccccggaacaccttcatagcggcgagagatctcgcatggtgcaaggagcgcatcggaagcgtatggaacgacgatccggtggtagccgatgaggaatccttcgccgatatcgaccagatgcggaagaaattagtccaagcggaggacttcctacgggaggtcttggatttccgtcgcatccatttcggggcacggccgatgggaacggcggacgctaccatccatttctctacgcaaacgcagccgatctatcataagaatttcgaccgggtgagtgagtcgttccataaatacctcgacgagggctatacattatatatattgagcgatcaagagaaacaagccaaccgtatccggatgattttcgaggataggggcgacaatatccctttcaccgccgtaaaccgcacgatacacgagggattcgccgatgatacgctacgcatctgctttttcaccgatcatcaattgttcgaccgcttccacaagttcaacttgaagagcgataaggcacgaagcggaaagatcaccctttcgctcaaggagctgaaccagttctcgcagggggattatatcgtacatatcgatcatggcgtaggacagttcggaggattggtacgcaccgaggtgaacggtaagatgcaagaggccatcaaattgatttatcagaataacgatattatattcgtcagcatccattccctgcataaattatcgaaatacaaggggaaagagagcggcgagccgcctaagttgagcaagctcggcacaggcgcttgggaaaagatgaaggaacgtaccaaggcgaaggtgaaggatatcgcccgggacttgatcctcctctattccaaacgcaagcaagagacgggtttcgcctacacgccggacagcttcatgcagcatgagctggaagccagcttcatctatgaggacacgccggaccagatgaaggctatcgccgaggtcaaggcggatatggaaagtacccgtccaatggaccgattgatttgtggagacgttggtttcggaaagaccgaggtagctatccgcgcggcattcaaggcggtatcggacaataagcaggtggccgtgttggtacccaccaccgtactggctttccagcattaccagacgttttgtgagcgcttgaaggatttcccttgcaagatcgattatatcagccgggcccgtacggccgcgcaaatcaaggctaccttgaaagagctgaaagagggcgaggtgaatatcttgatcggcacccaccggatcgtcggcaaggatgtacgtttcaaggatctgggcttgcttatcatcgacgaggagcagaagttcggggtatccgtcaaggagaagcttcggcagctgaaggtgaacgtggacaccttgaccatgacggccaccccgatcccccgtaccctacagttctccttgatgggggcccgggatctttccagcatcaccacgccaccgcccaaccgttatcccgtgcagacggaggtggagcgtttcaaccccgatattatccgggaagcgatcaatttcgagatgagccggaacgggcaggtgttcttcatcaacaaccgtatccagaacatctacgagatggaaaccttggtacggcgagaagtccccgacgcacgggtagccgtggggcacgggcagatggaaccggagaagctagaaaagatcatcctcgatttcgtgaattatgagtatgacgtattgatagccaccagtatcgtggagagcggcatcgacgtgcccaacgccaatacgatcatcatcaacaacgcccagcaattcgggcttagcgacctccatcagctacgcggacgtgtaggacgaagcaaccggaaagccttctgctacctcctttccccgcccctcacctcgctgacgcaggaggcacggcgcaggttgcaagcgatcgagaacttctccgagctgggtagcggtatccatatcgccatgcaagacctcgacatccggggagccgggaatatgctaggcgccgagcaaagcggtttcatcgccgacctaggctatgagacgtaccagaagattttggaagaggcggtagacgaattgaaaagcgaggaattcgccgatctttacgccgataatgccgaagggcaccgggatacgggcagcgaatacgtccgggagacctatatcgagagcgaccttgaattgatgttccctcccacctacattcccaacgactcggagcgtatctccctataccgggagttggataatatggaggaggaacgtgacatcctcgcctttacggagcgcttgaaagaccgcttcggcaagataccgaaggagggcaaggagttgatccggatcgtgcgcctccgccgcatggccaagaaactgggcatggagaaagtggtcctgaagaaagggcagatgagcctcttcttggtgaataacccggatagcccgtattaccaaagcgaggcgttcggcaagctgctgggcttcatccaaaagcatccccgtgagtgtaacctccgggagcagaacggcaagcgaagtatcgtgatcaagaacgtccctacggtggaagcggcatgcggctacctgcaagagatggaaaaaataaactcaaccgacttttgacacatcctcttacaaacacgaaaagatatggaaaagaaaacgattatagacctttttgagagttcagtgaagcgcttccccggtaatccttttttatgggagaagacgggcaagcgattcgagccaaccacttactccaaggttcgcgacctcgtctatgaggaaggcgcaggcctcgtatcgctgggcgtgcggaaaggggataacatggctttgctgagcgagggccgcaacgcatggatcatcggagagctggccatgttttacgccggggccaccaatgtccccctatccatcaagctggaggaggcgaatgacctcttattccgcctcgtccacgccgacgtgaaatatatcatggtatcgggccagcaactcaagaaaatccgggcgatcaaggataagctccccgccgtacggaagatcatcgtactcgacgagcaagcggaataccaagaccgtgagatgtcgctgtccgagatacgccggatggggaaggtctatctgggtattcatccgctagaggagttcttggcgatcgggcaatcgctgggcaacgatgattacgccaccatcacctatacctccggcacgaccgccgatccgaaaggcgtgatcctcacccaccgtaactatacggcgaacgtggagcaagcgctcacttgcgtggatatagacgatacgtggcgtacgttggtgatcctcccgttggaccattgcttcgcccacgtggtaggattctacatcttcatgtcgaagggagcctcggtagctaccgtgcaggtagggcgtaccggtatggagaccttgaagaatatccctatcaatataaaggagttcaagccgtacctgatactgagcgtccccgccttggcgaagaacttcaagaagaatatcgagcaaggtatccgagcgcgaggcaagaacgccgcccgccttttcaacctagccttacggatcggttatatctataacggggatagcgacgaggaggaaggaaaaggtttccgcgtcctcttgaagccactggtccgtttgttcgacaagctattgttcgcgaaagtccgtgagaacttcgggggcgagctgaagttctttatcggagggggcgccttgctggataaggacttgcagaagttctattacgccttgggaatcccgatgtaccaaggatacgggctgagcgaggcgacaccgatcatctcgaccaacggcccccgccgccataccttcggcagtagcggtgtattggtacggcccctcgacctaaagatctgcgacatggacggcaacgtacttcctccgggggagaaaggcgagatcgtcatccggggagagaacgtgatggccggctactggaagaacccggcatcgacggccgataccgtaaaggagggttggctgtacaccggggatatgggatatatgcgtgacgggcttctttatgtgttggggcgtttcaagagcctgctgatcggaagcgacggggagaaatacagtccggagggtatagaggaagccttggtagagcattcctcttgcatcgaccagctgatcctgtacaataaccagagtccgtacacgaccgccctgttggtccctaacaaagaacggttgaggaagcatctggcccaccagaatctggacctcacgagcgatcaaggccgggaagaggccatccgtatcatccagcgccagatcgaccgtttccgcaagggaggcgacctgtccaccctattcccggatcgttggttgccgaccaccttcgccatcctccccgagccttttaccgagcaaaacggcatggtaaacagcaccatgaagatcgtccggggcaaggtagagaaagcctacgccgcccgtatcgcccagctctatactcccgaggggaagaatccgctgaacaagtggaacaaggaggcgttgtagagacgcggcgagccgcatctcatccctcgcgatgggccttgctaccccggcaaggcctttgttgtttcaagagggccgcgacaaatgaataataacgagatttcatacaagattctgattacagaatttgtttttgtccgatttaatccagacctttatgactcaacatttacctattctattcaaagaataaatggtcccgtctcttcggagttccttctcaagatcaacaaaggttgataatcactcttttctcatgctaatctctaaatccaatctcatatgaaagcaacgaatactttactgagtacgattattatcggcgttactttaataatcatgacgggatgttcacaaggtgaagatcttatagatgctggcacccaagcgttaaacgcggcgacaaacaatgacaaggagttggtcttaaccgcctccgagcaaatcgccctttccgtaaaacagaaaggttcatacgatatctcggaaaaagaagcgaaaaagaacttcgagagctacgctaagaccatccacaaggagaaagccgtaaaagtaaaagccctctcattgaagaagaacaagaaaaacgggagaaacctatactacgaagttatattcgaaaacgacaaaggaacgggattctccctattatcggcagatgaacgtgtagacaagctactttgttactcagaaaacgggtctatatcggacacctcgtttaacaagagcttgaaatactgcctagagctagtcgatttgtatgtggaggggcaaacccaaaaagaattagacatagaaagtcttgcctcttcggcgaaccaaaagattaaagcggcaaataaaggcaaggtaatcaccaaagcactcccaccttttgaccccgacgacccgaatagcccttggagttatgaccggacagacgtgaaaaacgaagtcaccgaaaggatcaagcaagttcacgcaggatggcatcaaggaagtccgttcaacgatttattgccattgcttcctcccgattatacgcaaagagcctatacgggttgtgctatggtagccgtctcgcaaatcatggcatatcaccaaaagccctacagcaattatatcacggcggcgatgtggcctacgatgatcgcgaatttagacacctccgtagagctaaagcgccttatgcttgatttgtttaatacgatgaacacaggatatgatgcgaccgggacaagtagcaatatatccaaagccagagacttcctaaacaataacggctataccgccggatccgctcaagattatacatttgacagggcttggagagcgttaagctatggccctacatatataagaggaacaagagctagcggtgacggtcatgcttggattattgacggagtacggaacacgagaaccaccagtaccgatatttataccattacatataacgggagagtgtttgaagcctccggtagttcttccatcacctcctttcagaccgtacggtatgattggggagggggtaatgaaaacgataacacttggtttaacagcggtatttttacgccatcatctaacacaagcccatacgatcgaaatgtacggatgattagctatgtttattaatcaatttaaaacttcaaatcctatgagaaatatattccttttatactgcgtagcgctagccggcctctgcgcttgcgaatcggaagaaaaagtatatccagacgggcccggtcttaacgaggtaggcatgcagatcgtgctgacagacccggagctgaacgatctcttgaacccggaatcccccagcttccttggagaagaatatacgaaaggcatcctcgtcatgtaccttaacgcgggcaaaaagaccctctgccaattcgtgcctcaatacacgaacgagggaggtacacagaaagagtggaacatgatctatccaccctacgaggactatgaaagagacggaagggtaaaaaagaacacgaaaggatactattacctcccgttcccttttaacaaaacagaagagaatcaggatgtctcctatatatacgttcagtacccaaacggaagcgaggatgagataaaatcacaaatgtacatcgccgacggcatattccttatagaccagatatgggtcaacggcgagctcgcctattccatgtctccccgagaaggctccctaagcacgaagcagtattacaacccggaatattatccgttcttggttcctacgttagatgacaatggcaagcagatcggggatctggtacagcccgagggcggcacgcgtatcatcgtgatcaagaagaaatgatttatcgcgaggcccggccaccaaggttgggcctcgcattttctaaagattccaccgcgcacctgccgcgggataccgcatttctccaagattcggcctcgcgcccgatgtaccccccgcatttttcgcgaattccaccacgcgcctgccgcgagatgccgcatttctccaagattcgacctcgcacccgatgcaccccccgcatttttcgcgaattccaccacgcacctgccgcaaggtggaatatttccctaagattccgtttcgcacccgatgtaagccccgtattttcgcaagattcgacttttcacctgccgcgaggtcgaatccgcgaaaaacacggcggttcccagagctatatcaatcgatttgtcgtacctttagccagtgttaaacagatcatggatctaaatcaataagaaaatgggaaagattacaaaagtaaaagacattaacatcgcaaaattaaacaacgccgagtaccggaccttcatggcccgctacgggagcctgatcgcaggtgacggcggcgattccgaatctcccgacgagatcagcttcgacccgaacgacccgctgggcatccccgccgagctgcgcacggccttcgacagcgacttcaagctgctgaccgacgccgtcaaccaatcctccgccagcgaggaaaccgcgcagatgtccgccatcgacaaggagcgagacgacctgctcaccttcatcacctccaccgtatcgcaaatgatgaaaagcccgctggcggcgcaacgcacggccgccgagaagctatacctcgccgtgaaaccctacatcggcgccgcacgcctcgccaacttgcaggagacggccgccatcgagggcttgctgaccgacctagccaaggagggcatgcccgaggcactggcggcgatcaccctcaccgaggtagtggccgcgctgaaggagaagaaccagcaatacgcagccttgaccgagcagcgcaccaacgcacgggccgacctcccggtggagagcgccaagaaaatccgcctccgcatggacgaggaatacgacgagatgaccacctacgccttcgcccaaagcgtggtgaagcccactcaggtgacggccaccttcatcagccgcctcaacgcgctgatcgacgagaccaacgccctctacaaccaacgcatagcgctcgtgaaagccgccgccgccaagaagcaagcggatagcgaatcgccgtcagagatataaagccgtgaggccctcatgttttttagatttaagaatgatggggctcccctccctccaaggaggggatgccccattgattaatgattattaatagcctctcccccctccctcccacgaaaaaaacatacctttgccaacagtattatccgtgaaggaataacgagacatttacatgataagatctattcgctatatcactttgctagtcctgttacaattcgtgaccggcatttccgtcctatacgcccagagcataacttccgcatccggaatcgtgagagactccgtaagcggggaacccctatcctacgtatccgtcatgttcgagaactcgacgatcggggcgatgaccgacgatgacggggctttcagcctccagaatgacaaagggcttacccggctggtcgtatcctcgcttggatatgacaataaggtcgtaaacctaaaggcggggcaaaagaacaacgccctcaacgtgctcctccggcctacctcgttcgagattgccgaggtagtcgtcaagcctaaacgtgagaaatattcccgcaaggacaaccccgccgtggaactgatcaagaaagtcatagagcataagaacgacaaccgcatcgaggcgaaggacgagtaccaaagcgaggtgtacgagaagctcagcatgtcgctggacgacttcaaccccaatctcgagaagaataagttcctgaagaaattcaagtttatcaagaactatctggatacctcggagttcaacgggaaaccgatcctgacgatctccgtccgtgagacgatctccgaccaatactaccgcaaacatcccaaggcggagaagacgatcaccaaggccaagcgccagcagggtatcgacaagacattggacgatggaggcgccatcaccgccaaccttgaggagatattcaagggcgtcaatatctttgacaacaatatcaatatcttgttgaaccgtttcgtgagcccgctgtcttccacgctggccgtctcctattacaaatattatatcatggatacggtggacgtagccggagataaatgtgtggatctcgccttcgtgcctgtaaacagccagagctacggcttcacgggccgcttgtacatcacgctggacggtaattacgccgtcaagaaattcctcttgaacaccccggcgaacatcaacctcaactgggtggacaagctccggatcgagcaagagttcaagcggatgccggatagcacttgggtgctcgccaacgagaatacctacgtcaacttctatatcgtaaagggggcgcaacagctctacgcccaccagctaaggaatttcgataagtatcagttcgacgtgcagaacgccgactcgatcttcggccttctcggcacgatccatgagttgcccgaagccaccgcccagaccgacaccttctggatacacaaccgccatgtccccttgaaagagaaagagagcgccttggacgacttgctggcgcaacttcgcaaggtaccggctttcaacgtgatcatcaagaccgccgagatattgatcaccggttatatcccgaccacggcggacaaggataagagcaagttcgatttcggaccgatgaataccacgttcagcgccaaccatctggagggcttccgcatgcgtgtgggaggtatgacgacggcaaacctcaacccgcactggttcggtagcggttatctggcctatggcgtaaacgaccgtaagctaaagtataacgccaagctgacgtatagcgtgaacaagaagaaatatcacgagggagaaagcccggtgaacaatatctctgcgatccaagagtacgacgtatatacgcctggtcaggacttcctcttcaccagcaaggataatatgttcgtggcatggaaggtgggcgagcccgtcaccatgatgcaatacatccgcaagaccatgctccagtaccagaaggaatggctgaatggcctgacccttaccacttgggcgcggaacgagaacaacgaggcggccggaacgctccgctacgaccgttacgacgccgacgggacattgacgaacctaaagagtttcaccaacacggagctagggacccagcttcgtttcgccccgggcgagcgtgcctataacggacgagagggtaagaactcgcttttcaacctctcgaaagacgctcccgtattcaagctatcccatcagatgggattgaagaacgtgttggggagcgacttcaactacaaccatacggagatcagcgccgagaaacggatctggctctcttccttcggacatatcgacgccttggtgacggcgggcaaggtatgggacaaggttcctttccccttgctcatcatgccgaataccaaccagtccatcacgatccagccgcaagccttcaacatgatgcgtgcgctggagttcgtaagcgaccagtatgtttcgttctacttcacgtattatatgaagggatggatcttaaaccgtattcccggcgtgaagtggctacgtttgcgtgaggtgatatcgttcagcggtttctacggaggactgaccgataagaataacccggccttggacccgacgggactataccgcttccccgagggaacctcgccgatgggccgtacaccttacctggaggccagcgtaggtctggagaacatcttcaagatattacggatcgattattaccgccggttgacgtatctggaccaaccgaatatcaagaaggggggcgtgcgtatagcgctgcggttctccttctaagagttgacagttgagaattgacagttgacagttaaatgtaggagagataagaaaatgggggagttggaacgcagaccgaacgcatgggcattgacgccgctggtggtattcttattgacttatttggtgatatctatcgtggcgggagatttctataagatgccgataacggtagccttcgtcatctcctcgatcgtagcgatagcgatctccaagggaggcaaattaagcaaccgtatcgagcagttctgccggggggcggccaatagcaatatcatgctgatggtattgatcttcatcctcgccggggcgttcgcgcagaccgccaaggcgatgggtgccgtagacgctaccgtgaatctggcgatgtccatcctgcccggtaacctgttggcggccggaatcttcttggccgcttgtttcatatccatctcggtaggtacgtcggtgggcacgatcgtggccttggccccggtagccgtcggtatagcggacaagacggggatgccggacgcccttatgctaggtgtcgtggtgagcggcgccatgttcggcgataacctgtcgttcatatccgatacgaccatcgtagctacccgcacgcagggttgccagatgtccgataagttcaaggtgaatatccgtatcgccctcccgatagcgatcctgaccggattgatatacgtgctggtgggaagcggcgtggagaacgcttacgccccggccccgatcgaatgggtcaaggtgatcccttatctggtggtgttggtaaccgccgtttgcgggatcaatgtcatgctggtgctattcatcgggatcgtcctgtccggtatagtaggtttgtggaccggtagcttcgatatctggggctggaacgcctccatgggattaggtatcaccaatatgggcgagctgattatcgtgacgcttctggcaggaggcatgttggagatgatccgctataacgggggtatcgactggatcatccgcaagcttacctcccgcatccattcctccaagggggccgagatgagcatagcggccttggtgagcttcgccaacctttgcacggccaacaatacgatcgccctcatcatggccggcccgatcgccaaggatatagcggaccggttcaagatagatccccgccgcagcgccagcctattggatatcttctcttgcttcatacagggaatcatcccctacggcgcccagatgttgatggccgccggactcgggcatgtctcccctatcgagatcatgcaatatctttactacccatatctattgggagcaggcgccttattggcgatcgcattcaattatccgaggaaatatacactcgtatagactgcccgtccttacgaaaaaacacaatagtattcaaagcaaaaagactattgtgtccgagattgaatactattgtgttcgctgatgaatactaccgtgttcaagtagaaacactgtagtgcttgggagcgatgggaatacggcagtcggattagccgaacaaatccagcgtaagctgtttcttcgcggcttccagtttacgaagatgccgcttgccttgaggggtgacgatctccatcttatcgaaacgggtacgtatcaccgtagtcacggtatagctcacgttgaccacctctcctagctccgacagacggcgagcgatctccaagacgcaatcgatgcacatgccgctcgtgaacgagatcttgtcctcgaacatctgtttcttgaaatcctcatcttgcatatagaaatcgattgtctcgcctcccttgttgtaaatacctttccagcgatacttactgtctttcagtaccggcgagatgatctctatcgtggccttattatccttgacagtaggcagatcgtcgctacgcaagataaaataatcgaactggtcccgcttcacctccagcgaaccggaacggctacgatccttctcgttcaactcacgtaccgagattttcgtcaccttcggataccctttcaaagcctcgtagaaattagacttacacttacagaaacggggcgaggcgttcaacaggtcgatcaagcggtgtgaaggcgtagcccccggagtcttcagtcgtagttcacggcgtaacttggacagctcacgctgcatctcctcctcgtccgccggcgtacggtccatcagcggttgtccacccaccgacaaggagggacgggtcaatatctgcatcaccaagttcaacacgatagagatagagcggctactctccccggccacgcccagcttctcacggaaaccaccctccttatcgtaaggctcgttgtaaaccgtcagcttcacgtccagcatatccgccaaggaacgtatcagcgtaagaatctccttctcacaccggtgcttggtcatggcatccatataattggatttattattaaaggaataacgtatctccagcttattcgcgaattttagaatagagtcactcatttgtttctagtttttcggttcttctttcggtttacgatcaaaaaacgggttcttcgacgaggcgctgaccggtatcgccatcacgcatttacagtctcccaacagccccaatcgctgggccgccaagccggcgctgaacatgacacgggtatccacacgcaagtccgccgccgtagcgcaagccgagccgattgcgatacccagatcgacggaattaatagcgcacggaaccaaatccggcttctccacgcaggtatcaaaaccgcaatgggcgcagttcaagccttgtattttctgggaggtaccgataatcaccacggcgtcggcactctttatattctcggcgtcacggagcaggaacttgaatccggtctcggccgctatccggatcatctcatcggataggcgcaagatatccccatccgtcaccatcgctatctctatgatatcaatacccttgcctttaggagccgtgcgagcggctgtcatcatacggcgtgcggcctgtaacacaagctcatgcctgatttctctttcgttctgtatcatatccttctaaattcaatgaaacaaaattaagcaaaatatacgaaaccaaggcaaacacatgaggatagaattcataattcaagattagtcattcggtccgtggccttaaagggataagccgggtattcataaatactgaaacgaggctcggtctctccctcgcaataattccagatcgtacggtactcattgacatcctcgcctatctccttcaattgcctaaggtaagcggccacggatttattctccacgatataggcctcacccatttgatcgataatcgggctatgccgacggctcccgtcgtgatcgaacttaagaatccgctttccctcggaagtcagtccaatggtatggaaagtcatgctcttaccaatagcgggcaagttcaacacgttacgatccgtcccggcgaacagcaacccgttctccttcaggaaacgaaccaagcacttgcctaaaggacgctggttacggatcatatcatacaactccgcctgtttctcctccggcacctgcccgaagatcttctcctcacgagcctcttgcaacgagcggctattcggggtataaaccgcataattctcccggaatcccttcacggagaacgtataatagcaaaccaccccaagggcgtttaaggtctgccgtaatttcgccgtatgccccctacgggaagccgagaccgtataaaccaactgattcgtgatcgtccagcccgccgccaagatcgcctcgatagcgtgcctcgcctccggtgtcacctccagtggagactggaaatgcgtttgtatatagaactggctcacgccgatagcggaagccttctccttgaactccctcaatataccgaccaactcgtcggtcacacgcagcggaagataagccagcaaccgggaacctagccgtacccgttgtaactcggcgtacttctcgccctccggacggctctcgttcgccttccgtttccgcaccgccatcttatataccgcctccaatattttacgcaaggtagcgttctggctcatcaaggcatccccgcccgttatcaagatatccctcagttgggcgtcttcctcgaaataacgcatcagacgacgtaacttccggtcccaactctccttaggcttcagggcctcgaaatcgaaattcaaccgctcgctctggaaatcatacatgcgctggcaagaagcgcacaatccaccgcaggcacgccccatcgaatcggggatcaagatcgccacctccggatacctccggtgtatattatgtccctccggcaatagccaacccgccgcgttcggctcatcggcaacgaccatgtcttccttttcccacgccttaatgcttccatacgtatctaccagctcgttcgagtacatgatgtacgatcgcaccgtagcgtcgtcatacccctcatgttctatatttaatagggaaagataataaggagtcacaaaaaagggcatccccttctttttggcacgggccaataagctcatcgtctcgtccgacagggaatatcccaaaaagaagttcaattccgtaggactcttgatcgccatcgacaaatggaaacgagcggtattccaccattcacgtacccgagcctctttctcctcataggagatgccctcggcgaactggaaacgtgacgaagggctatggcgtctttctatcttcttgatcaagcaagcgatgatacgctccttgttcctctcacggatagcgatcacctccgggtcaagcccggtcggccagcggctcatctgccttttcaccaatgcccggtccggcaggatctcaaccggatgttccaataaatcaaactgatggtataggtcgataaataaatcaggagagacctcattttccaaatggccggtcaggaactgccaaagataagtgaccgtccgcaccggaagacgctcgcccgtagacagctcgtccacgaaagtatcatcatgctcaatcaaaagaaggatacgcctcgccaccgccattcctacgttttcttgggtactttccttttccgtgagccaggataaaataagagaacgcaaagcatccttaaaatactttgcgttctcactttcttccgctaaggtcaccaaccaagggaagctctggttatatacttttttcagtttagaaatgtcggatacaagatgttctttttttatcataagcatgtcatttttgtagattagaatacatttgtaaagcgtcctcttgacgattttctacaaaaataacaaaaaatacggcaaaatgccgtttatacaaatctaaaacatcttaataaatccttaccatacgattgacggacaatactgcgatatcgtatttttcaatacctttagattgatcggcttcgtgataaaaccggaagccccggcttctttagcggcttccatatcagagtcgaatacataagccgactgcatgattacggggatatctttcgatagcttacggatttccttcaaggactcgatacccgtcatctcaggcatctttatatccatcaagatcaagtccacctcgttttccttaaagagagccaaagcttccaaaccagttttagcacggatcaaattacaatatttatgtaaaatggtcttcagaagtaaataattactttcctcatcctccgcgattagcaacgtgggctttcctccacccaaatcatttttcacatccatatatataacgttttattcttttaatcaaaatcaaataaactctgatgaagcaaagataaaacaaatattagaaagtagacataaaattcaaggagatatgagtattcggggaagttctttttccacccatgctagaaagttacgtctatacctcccataaatatcgccttcggcatcgggaatccttcgttgatagaataacgggtagccgttaaattctctcctttgacaaatagattcaagcctttatcacgtgtaccgaaacggtaggctgccttcgcgttcaaaaccgtgtaatcctctttcaccttgtccgccgtattgatataaaggtcgaaaatggattgtacgttcacgttgaaagtgaaacgtcccggggcatacatcacgccagcgaaaaacttatgcgccggagccgccagcagggccttgctcgtatgcaaatagctatagttcatatcgaggctcaaattcttgagaatctggtaacgggaatcgaactcgatacctttattcgtaaaagtacccgtattgacattcttaggccgtccgtctatacgtgtcgtctcgatcatatcctgcccgtcgataaaaaaggcagtcaactccgtaaacaagttgccgtccaaaaatgtctgcccgatggatacctcgtagttcatcatgcgctccggtttcaaatctgggttctgaggcgggaacatgtacatctctcgtatattcggactccggaagcctttcgacaaagaagcctttatcacgttcccctcgaacggacgtaccgtgaagccggcctgcggaatccactcgccgccgaagatactgttatgctcataacgaaccccggcgttcaagcttaccttgtcaaatagatcctgctgcatgataacgtatccggctacctcgttcacggtcttattcaccaactcattctggttaccattgatactatcctgccatgcgtgaccaccccagttcttataatcgatgccgaccgtaaaactattccctttcaccaagcggaaagactgataaagcaagaaacccgcattatgatcgtccgaataaaacagataaggattaggcgtcccgcccggattatacccatcatcaatcttatgatggccccagttgtagaaagcacgaagggcaccacttgtcttcccgtaattattctctaaagcgaaggaggtagtacctcgcaggatattcatgatattatcgataagcggatttgttatctctcccgggttctggttcttgaacttagctaagcttacgtctcccgtcaccttataatgatcatcaatcttatatcctaacttagcgaaaccattcgtgatatgaaacttcgaatccggacgatgtccatccgtgcggtcatgattcaatgagatataactactaaagttaccgatattgtacccattattaatcatatacttctgggtgttatacgagccgtacatgatacgggcttgtgtacgtcgtcccggctgattatgctggcgggtaatgatattcacgacacctcccatagcgttcgaaccgtataataaggcacccggaccacggatcacctccaccctttccacgtccgaagccacataggtatccggaagcgaatggccgaatataccggcccattgaggctgtccgtcgaacaacatcaagaccttattaccctgtccgacaccccggatattaaccgtcccggccgctccctcggaaacgccgaaacctgtaatccctttttccgtgacaaacagcccgggtactcgctccgacaatacgggaagcaacgccgattcactgctagcctcaatctcctcccgttcgatgaccgagatagataatggcacactgttccggttcacatggatcttgttggcggaaaccaccacccctttcaaattgatcagactgtcaatctctaccggatctatcgcaaatgccatggagcttaccaatagtccggaaactagtaaaagttcttttctcatatactacttatatctatactatttatcattttaaacatcccttagtggcacgtctgccaaaaaacgtgttaccaaaccttcaaaaaaaagcattaatccgcccggctcatcaccaacttaccatgcttaatgcctttgattgtcgtcaacttatccgacaattccgtcaagcggtgggccgttcccatcaccgtcactatatgcaagcaaaaattctgattgatataatactgggaagacgacaagatcacatccttataattttgttggatacccatgattttcaatgagatctctttcttgacttggtcatacatgatcacgatcgtcccggctacgatatggttgcattgccatttacgttcggctacattcttctctatcagaaaacgaatcgcctgcgaacgattggcgaagccattctcattcacatattgatccaatgattccaacagattgtcttccaaagagacaccgaaacgttttaaagacataaaacctttttttataattttcggtaccaaaggtagtgttttttcaagaatctcggtattctatcggcaggaagaggaaaaatcagtcgctaatcacgaaaattcactccggtatcccaccataagcgggtacctccggtatccggacctcccaaatactcacacaaggcggaatactgagccgggttaccggaaataatgctaaccgggaaattcaaacgacgaatcatcgttcgcgtatcgatctttccattgcttttattcaccaaaaccgggaacaaacggggataaccggtacgcctctgctccgcccaagcctcacagccctcggggtaacaagcgatccatttttgggtaatgatcttctccagcttggtctccctagaggcttcttcatcccatgccggagacaccaagcaaagcgccttcgctgaatattcgggagtaaacgtatccacgaaatcggcggctacaagatcactccgcaaataagtattggcctctcctaccctccattgattgaacgatgatcgtacgccttgctcatagcaagtcccggcatcctccccggaccagcctctcaaggctgcctccgcacgtaagaaccaaacttccgcgggcgtcattaatatagcgtccgttttctgggtaatcgtgcttctcgaatgctcactatagcgggaatgattaaatcctgtcccttgccggattccccggtactccccggaatatccctgtccggtagcaggctcaaaataacaggataaccgagggtctttatatcctttaaggatcgattccatattagcgttcataaaaacctctccccacgccttattgatctcccctagcggattcgagtagccggttccggcggtagaaaccgcgacgacctcataagcctcctccagcaaaccggctggatgtgtcagcgacttatgcgcctcatcccttgccttatcagggtcggccatagcgatacgaaccgccaagcgcaaacgtaatgagttggcgaaacgcatccattccccaaacgtcctgtaattctccggcataatcatatcgaaacgagaaaaggtttcctctccatcatattcagacagcaagtgaatagcctcccccaaatcccggaaaaaagcataataagcgtctttctgggaatccggcattaccccggcatccgactccccgaacttcgtatacacgatcgggccataataatccgagatccgatgcatgacctctactttcagtattttagcgatcgcatagaaagccggatatttatcacgggaatgatcttccgtctgctttatctccgtcatgatatatccatacgtattatcccacatcgtgccattccagccatcctgcaaattatagaccgtatttcccaatccggcgttgaagggtttaaaatcatgcatataaccggaaaacatatccgcattcagattttgcatcgtttggaaatgccagttcttaccattcccccaatcataattaaaataaatccccatctggactacttttaaccagacaccgaacgtattataatcatacgttttctgctcgtcagtaaaccccgtactatcggtattatactcctcgaatttacccgtacaagaaaaaaggagtaatacgaccaacagacttgccatttcattcagaaatcttgtcttcatacacttagaatgaaagtttcacattaaagccaacacttctcgtagtcggtatcccgaatatatcgatcccttgattactattactcaccgaaagtatggcatccggatcaaatggagcctttttataaataaagaatagattccgggcgacaaaagacagttccgcctttttaacaaattgttttcttcccaacaatctcttcggtagcgtatatcccaaagataactctcgcaaacggatattggtagcattgtacatataatattcggtcacgccgtttcgtcctcccacctgctcataaaatccttttatgttataaatatgatgcccttccaaatccacataccccatcgtacgggcctctccagaaaccttactcactcctatttggtcaagcacagcctgcgtctgggccaatacctctcccccaaaatgcccgtctatcaggaaatagtatgagaaatccttatacgtgaaactattcccccaacccaataggaacgccggattgcaattccccaccttaaccgtattcccgctaccgatctcttggggcaaaccgtcccggccatacacgatcgcaccatatttatcccgctcaaaagctttcccatagatatcgccaaacgaaccaccttccaccaaacgcatcgcatagctagaagagaacccttcgtttccttgaataaagctagccaaatcatcgtgcagtttttttacctcatttttattccgagaaaagttgagtgtcgtattccatttaaactggttcgttaatatgggaaccgcacctagcgtcaattctactcccatattctgtatatttcccgcattcacaaaataatacttgtaagcggctccagcggaagaaggcaaagaaaagagttgctctttcgtgttggtcttataaaacgtaagatccacgtccatacgataatcaaagaatttccattcagtacctatctcaaaagagctgctcatctccggcttcaaggtaccgaacggagccgtatcattcggctggggaatcccgcccgctgcgatatggcctaccgtattgctaacgaataaaggtatatcattacccaccttactccaagaagcccgtactttcccaaaagatatcaaggaaggcatcgagaaggatttagggataatccaagaaagaccgactgaaggatagaaaaaacctcttgatttacgttccgtaaacgcaagggtagatgaccagtcattacgtgcggtcacatctaagtaaaggctttccttatatcccaactgcgccatagcaaaaaaggattgcatttgccggcgtgcgtcatccgactcctcgatgtaggcactggacgacatgttaatattagcaatcgtaaagacattcggataatacaaggaagccgttttcgaatccagcctcaacgcactggtgcgtgtgtccgttatgctcgtaccgatagcggcgttcaaggagaaatcatcccagcttttattcaatttggccatcaaatccccatagagcaacgtagtctggcaggtgtaataaatgtaacgcccgttctcaccggcgatacccggagaggtagaagcgtatatttcctgctgatacttatcattcacataatcgatatttccacggccctgtaacgtaagccaatctgtcaccttgaaactagcggaagccaacgccaacacacgggcacgtttatcctcgttttccgtacggttgaccaaccaataaggattttgctcaaaatcagtaatcgtagtataccagttctggacgttcatattccgtttctcgttatatacctcaaagttctccttataaggcgccatatccatccctctaggaaacgtgtataaaccttgtaacgggttcatataaaatcccccgaccgtaggtttccctttgattgtttggagtatcaagtttgcctgcccctccaagatcaaacgatcatcaaagaaagaagaactttcacggagattaaaattatgcttgcttaaattattcttaggaacaatgccccgtgcggtcgtattggcatacgagaaataattttgcacatggctattccctgccgtaaatatcaatgagttaatagcggtaatacccgtccggaaaaaatcgccgacagggtcatagaccggaagagaagcccggtctccccaacaagtttccgccccttccagccgtccaaactcattctgaaacttggggagactgatcgcttgatcgacagtcagcgacgaggagaaatgaatattccgtaccccggccttaccttttttcgttttgatcaagatcacaccgttcgccgcttgtcccccatacaacgcagaggccgaagcccctttcaagacactcaaactctctatatcatcgggatttaaattagagatattatctcccgcatctcgattaccggcatcagctgcacctccaatcgccgtcgaggtttgctcactgctaacacacaagatagggacaccatccattacatacaaaggttgattatttccggatacagaacgacttcctcgaataatcactcgagaagagctagccagaccagcggaagtccgatttatctgaagacctgccatctttcccgaaagcgtactcataaaattaaaatccttggtccttactaattcctctccagagatcaattgagtgacataaggtaaagaagatccctttttttcgataccaagagccgtaacaaccacctcgtctagaatccgagtatcatcttccagctgaacattcaaaaataattgcccctcatactcaatttctcgtgaacgataaccaatataagaaaaaactaaagtagtctccttaggaagctccaagacaaaacgaccatccacatccgtaatcgtaccgttctttgttcccttctccaccacattcacgcaggcaataggctctccttcgtgatcagtcacgataccttttatcttaccatccaatttttgttgtatctgaattattgtctcttttttactcaaaataatctggtcattcataactgtatagacaatcgtcctatccttaaacaataaatttaaaatctcaaaaaccgtacgtccagataaagggctacgcaacttctcagataaattgatcactcgagcatcataaataaaagaataattggtttggctctcgatctcatctaaggcttccgccaagctaacagaagctgaaatatgaatataagattctgcatattcctgttgggcatctagtgggaataaacataataacaatagagagaatacactaatacacaatctcataattcaacaaagattaaatgataaaaaatactcttatcgtcatgctcatagtgaacaaagttacagaaattttcattatggcaaataaattccgctaaattttcaataccacatccatcaaaccacaaggatttcaaatatttacgcacaaaactatgtaaacatatactcatcaaaacatatcgtataactgattcatgaagcgatgaaaacaagttgtggtacaaacaaagcccccagtcaacgtcataggcagtgtcctgctacatatatgctgcactcagcggaagtaattgattaaagcaataaaatcatctagtattacacttaaaaaaactctttatacataagtataaagattaaagcttcagattaaaaagaggatgcatgaggcatcctctttttataaccaattcattacaaagtgatattagaaggtatttgatctaaatcataatagtcatgaactatcttatccggatataccttaacaattcgaataccaattcgatcttcccccaaaggagtacaaatagaatttgttattgtaatattgaaatttccataagaactcatcgcattataatgtaaatgtccagcaaacatattacttactcgatatttatccataagatctaagtatattttccgtttttttatgggaatattctcatatctatttgtctcattaggctctttcacaaagaaaggataatgtccaaaaaggatacgatgattacatttctgagagttctctagatttttctccaaccagaccagttgttttttttctttttcttctctatttgcaaaaataataggagtatttaatccaataaaacaactattatttaaatgaaagcaaaaacaatcatatccatattcatccatataacaagaaatagactcatctgtactctgttgatttaaatcatgattacctggtaacacataaacagggatgtttttttttatcaaagtacaaattcgtttaaattcgttaatttgattttgatcttcaccatcatttaccatatcacccgttataaccacaaatgccggattcaaattattaataacagcaacaaccttttccatgatttttgtctcttgagagaaacttttattcttttctaacattccaaactgaggatctgataattgaataaaataaaaaggttcagactgagcaaaagtttttgtaacacaaaaaatcacagtaactagatacaccaataatctactcataatataatattttaattaatatcttcatactgaagtaatacagaattcgcctattcctttattttgaagatgtgcaatagttggaattcttatcccaccacaacggagtagatacaatatcgcctttaccacctaacatggatttgcctttctcgtactcagtggcattaatcaaactttcctttgttggatacctcattcgtttaataaaattagctgacttcaagatatccttatcattattattgtaaacagcttgatctcgatagacagcaacatccaaacggggtaaatttaaacgacgtttatcattccaaccttcttgcgccaaatcaggtatcccagcgatatatttctgagtaatgatcttttccaaagctgtatttcccgcaccttgttgatcatcatatctagcacttgtaccagcctcatttttctctgtagaagtcaggtagtcgtccacctcagaagtaaccccccaagtagcgaaagacgcacgaacacctgcctcatattccgatttagcatcaccagcgataaaaccacgagcatataattcagccttcaaaaaatgaacctcttcagaaaggaacaaatcatacggacgagatttatagggatagccatccttaataataaagccaagctcagcacattgtttcgattgataaattccggtattggcttcctctgccttaggtccatataccaaacctttccaatctccattctcaatacccggctggaaaatcttcggggcacgaggatctaccttttccggatgtacgctagaaaccgcaacaccggacgtctggttcactacaccttgaggccaagcgacaccaccaatattagtcaccagtttctcaaccgattttgacatacaaatcggaccactccatgtaatctggaacatcgtataattgtaatcctgtccccaagagccatcagccttcggtggcatataagcgttatcagccttatccgagatcaaccctgctggtgatgaaatagcggcatttgcctcagctatacatttctcctgatccacttctgtcaaacgaacagccaaacgcagacgcaaggaattggcaaaacgtttccacttcgatacatcattcttataaatcaagtcgatacccgcatcagaaaaaataggttgcgcactatcgttaaagccatttatggcagcatcaagttccctgaagtactcgtcatagatatccttcaacgatttataaggaggattcgcctctacaatctcataagcagggaaaggcatcgggccaaatttatcggcagccagcgtatgcacatatacacgccatatccgggcgaaagcaatcgtattcgcataagcatccttatccttttccgtcagactacggatcactatattaatagaggcgatctgtttcaaatattcttcccaaacgagattattccattcatcgtcttgaatatagttcttggtaccccatccaccaccatcgacagtcatctgggaataaaaatcaatctgtaatggtttcaaacgttgttccacgttaccttcgatgatcaagccaccacgcaatgtagaggctagacggggttcgttcatattatagttcacgtcgtctgttggtttatccggattctcatttatacccgtcaagtcgcaactagttgcacttagcatcattaacgaacaagctgttaatatctttatactcttcataataattctatttttagatttatgtttctttaaaaagccagattaatattaaaacctaagcttctcattgtcggcatagaaccgtactcaataccttgggcgttaccggatgtataagcagcttccgggtcaaagccctttgtcttactatagatcatgaataagttacgagccacgaaactcaaacgtgcggcggtaaatggagtcttagccaacatggttctcgggaaattatagcctagattcaattcacgtaaacgaatatttgtagcgtcatacatataagcttctgtattatttgaaacaccattccaataagcctgagaagttatactctttgtattcggggaaccgtccaccaatacacccggaactaccataccgtcacgaccatccaacgtcatctctaagttaccagatgaagcacccgcacggatagatcccatatacacatcaccgccataacgcatatcgaacatgaagctcaacacgaaattcctataagacaaggtattactccaacccatcatccatttcggttggttattacccaatagttccatgtcactcgtacgcaaaggcacaccatcctcaccgatgataacattacctttgtcatcacgttgataagcatagccatagatatcaccgtaagcacctccttcatgagccacaatcttcaagaaagtaaccgacttatcacttagaatctgctctttcgtatcctccgtcaatgaaacgaccttattattattttttgaccaattcaattgagtatcccattggaacccgttttccgtaatcactggggtagcattcactgcaatctcgacacccttattctcaatattaccggcgttaatcattttctttttaaatccagttgcggagggaacatcaatttttatgatctgatccttcgcattctttttatagtaagctacgtcgacaccaaccctattctcaaacgccttcaactcaaggcctaactcccaagagttgatcgtctcattctttaaatttggatttgccatccaatcctcgttgctggcattaaaaataccccctttaatatcataactgatattataatagtcacgcaacatataagcgtccgtatcattacctacctgagcccaagacgcacggatcttaccgaaagaaagaatacccgtgttatgccccatcttattcaacatttgggtgaaaatccagctaacacctaccgacgggtaaaaataagagtcattgtctttcggaagtgttgaagaccagtcgttacgagcggttaagtccaaatacaaatagtcgtcccaagacaatgatgccgtagcatatagcgagttgatttgtttacggttgcgagtatactcaccaccatgtgtcttaccgttggcgatcgcatggaaatcgggaatcacaaactcaccggatgattccttgtaccatgtagaattacggtacatcatattaccacctaccgtacctacgataccgaatcgatcccagttgcctttagcagtcaataagaaatcggagttgatctcggtgaatttctccatattggcagtcatgctaccgttgttctcccaatacgggttacctgtcgcacgaatcgtctcatactggatggtgtaattatccataccagagcgaagcttcaagctcaaccaatccgtaaacgtgaaatccaaggccgcgaatccgataaaacggtctttcttatccttgttcgtattgcggtaagcggaccaatacgggttattggcgttggctcctgtgtcgatcagataaccagcgggctttccgtccgcacgtttccaatcattatctttataggcgtcatagtcagagaagcccacacttcgaggcatacttaaatagttaaggaagatattatccgggtcgcccgctaatttcacacggttgttcgtatgctggcttacataattgaccttcacgtcagccgataaccatttagacagcttagccgtagaacgcaaattaatagacgtacgatccattccgctattcgggacaacccccttattatccaagcgtgtcacaccggcacggaaagtgatatcctcggagctcttactcaaatccacgctattcgtccaagtggtaccagtgcgcaaaaagtccttgtacagattattatctctagccgcatagggatgagatcccatcgccatatccttaggagaaccatccataacggcaccccaactcgtcgctttattattatcgaaagcgccgtcgataccttgtccgtatacatcttggaacttcggagtttgcatcgggttctcagccgtgaaattcgaattgatacttacgccccaacctttattctggctacctttcttagtcgtgatcatcacgacaccgttacctgcacggctaccatacaacgccgcagctgccgggcctttcaatacggacatactctcgatatcatctggggagatatcagagataccggaacctttatccacgttaccgttaccccaatagtcatccgtaccaccgctaaagttatcgataggtacaccgtccacaacaatcaacggctggttattaccagtaatagagttattaccacgaatcacgatacgagaggaaccaccgacaccggtaccattttgcttgatctgcaaaccagctaccttaccagccaaagcgttggccacgttagcatcacgggtttgcgtcagggactcacctttcaattcagacatagaatatcccaaagcctttttctcacgcttgatacccaaagcggttaccacgacttcatccaaggcttgcgtatcatcgaccaattgaacctcgatagaaggttgtccggtaaagacgatctcttgcgtattaaagccgatataggaaacttgtaaagtcgcattgttaggaacatccaactcgaaacggccatccatatccgtgatggtaccgttggtagttcctttgacaattacgttagcaccgataatagcctcgcccgttttgtccgtaacgacaccgactgcttttcgtgtctgttgttgagcgtttaagactgtgacttcatgcgtgttctctgcgaaaaccatggccggtaccaaacagaatgcgcatacccccatgttgatcattaacggaatttttcgaaaaagagaataactattcccccttaaagcatttaaggttacaattttattcatatttttgtagtgttactatttataataaagttatttgtagctgcgccaacagctcttcttgacttttcgtacgggagaatacgccaatattcttccgtatgtttttaatccttgtttattctttcttcatggcagacgtattttagaaggttacacattatttctcattttgatatttccacgactgaggttcccgatccactgtccttaacggtaggtttatgtatcgcatactggattcccgacgccaatttcaggtattccaatacttgaggcaattgctcgtccttgaaacgggctgttattatggacttcagtatctcgttatcttttacctcgaatactacgtgataatgacgttccagcgttttcaatactttatccatcggatggttcctgaagataatctccccgttcttccaagccgtgtcatattcggtattcacgtcgaacaccttgatcttgccagcgcccttttgatactcggctttctcgtttggcttcaacatctgtgtcattcgctttcctccggacacgacgttcagctttaccgatccctctaccaaggtggtctctatcatactctcgtctttgtaagcggatacattgaaagaagtacccaacacctctaccgagtaatctttatccgctttcacaataaaaggcttatgagcattcttcgtcacctcgaaatatccttgtccggttaattccaccgtacgggtatccgcattgaagtccgaaagatatctcaattcgctattggcattcagccaaaccttagaaccgtcaggtaaatcgaatgccgaaaccaccccaggattcgtgcgtacggctagcgtacgcacgttcccttgaccctgctgtatgaacaaataagcggataaaagaaagactggaatgaataacacggccgcagcccgttgaataacacctaacacttgtcttaaagctaatcttttctctttcttatggattcttgatttaaaacgagacaacgcctcgtccgggttcacggtccgcatgacttttaggcgacttgccacttgagctgtaaaatagacctgctccaacagtttctcgttttctagagaggcggcccgccagtttttcacctccgcagcttcctcctcggtcaacatcccattgatgtatcggatcaatatgtcttcgtttatttccattttttcttgtttctataattaatacagttgagacaaaagatgtactaaacaaaaaaacgatttttttcaagaaaattgaataatggcaaaaataccgttcctaaagaaaggctcaacaatatccctctttctactgttttaccacaaaatgagacttctaatggtaaagattcttttaaaacggatttatgaggagccaagtgaggcggatggttatcgcattcttctcgacaggctatggcccagaggactgaagaaagaggatgcgaagtttgacgaatggagaaaagacatcactccatccaaggagttacgccaatggttccacgaggataaagacaggcattgggaagtattccaaggtcgctacgggatggagatcaagcagaacccggatttcattcctttcttacgagagatcgagaagcatccggttgtcactttcctcacggcagcgaaggatgtacaacatagtcatctacctatattaaaagaagtcatcgaggatttcgaaaaaaacaaatcataaaaataaaaagacctatgaaaagtatcgtattgcttcgccacggcgaaagtatatggaataaagagaaccggttcaccggttggaccgatgtggatttgacagaaaaaggcgtggccgaagcttatagggccggcaacctattgaaagaaaaaggatatgtgttcaataaagcctatacctcttatttaaaacgggccgtcaaaaccttgaattgtgtattggatcgcatggaccaagactggatcccggtggagaagagctggaggctgaacgagaaacattacggatcgctacaagggttgaacaagagcgagaccgcccaaaagtatggagacgagcaggtcttgatctggcgtcgcagttacgatatagccccgcttcccctatcggaagacgaccctcgtaaccctcgcttcgatatccgctacaaagacgtgccggataaagagttgccccgtacggaatccttgaaagatacggttgagcggattctcccttattggaaagaggttatcttcccgacgctccggaccgccgaccagatccttgtcgccgctcacggaaacagcttgcggggaatcatcaaatatttaaaaaacatctccgatgaagagatcgttcatctgaatctcccgacagccgttccatacgtgttcgagttcgatgatgacttgaaactcgtgaatgattatttccttggcgacccggaggaaatcaagaaactcatggaagccgtagccaaccaaggaaagaaaaagtagcgggattcatgcctcttatccggaattattcattaagtttgcaaccaaacaaacttaaacactattgtggacgagaacgcagaacgaatttcactagaacttatcgcaggagacgaacaagcgttcgacaccgtgtacaaacaatattaccggggattgtgcgccttcgcctcccaatatgtaacagtaccagaatcggaggagatcgtacaagacgtgatgatgtggctgtgggaaaaccgaaaatccctagtagcggacatgtccctgaaatcactcctcttcaccattgtccgcaataaatgcctcaatacgatcagccacatacaggttaagcaacaagtgcacgagagattgtacgccaagttccaagagcaattcgagaatcctgatttttatataggagaactgatggccttggcctccaaggccatccgggagctcccggatgaataccgtaaggcattcgagatgaaccgtttcgaggaaatgacctacaacgagatcgccgagcggacaggcgtatcccccaaaacaatcgcataccgcatctctcaagcgctcaagatattacggacgaaattaaaggactatatccctttattggtatggctgctttacgaacaaacacgctcataacggaggaagcatcctaccgccatgagcgtttttttaatgagtcaaaagacttatttcacgaacggtgctttcaataaataatccacgcagcctttcacgccctcaaactgggaacgtccgtcaggcataccctccaactccacgaaataatccttgattccattcgcgtaagcttgccggaatatattctcgaaattcatcatcccggactcgcctagaatagcacggtccttgatgtgcaataccttaatacggttcggatatttcttcaaccactctatcggatcttgttgtcccatcacggcccaataaacatccatctcgaaaaatacaagcgaaggatcagtattcttcaagaacaactcatagatgcaatctcctttcacacgccttcccagcttggcctccgtactacccggatttaccttggcgaactccatctcatggttgtgatagccgaaaggaataccggccgctttcactatcttacccgcctcgttaaaaatctcgcagacgaaagcggtttcctcggtgctacgggtactcggttgcccgggctggatcaagtacttcacgcctagtttggcatggtcatcagccgtcttcttccaatactcggagatctgggagcgattggccttcgtgtactcacgtaccggaggattcacgtgggaactggtgatcttcaatccggcatcatccaccatcttcttgaattccatcatgtctacaccgccgatcttgccttccttgtaaccggccaattccagattcgtgtaccccatttgcttgatctttttcaatccaccgggtacatccgcataaagttccttgcctaaagaatagatttgtaaaccaactgtcttagcggccatcgtttcagaagtgacaggtttagccgcatctgcgctcccgacctttccggccatcaggccacccaaggtgaaaagggacgcattctttaaaaaatctcgtctatttatcatgattattagaattaagtcagtccaaagatagagattataatctaaaaaaagaccgcataggatggaaaaatccacctatacggtccacaaatggtatacattatataataggactcgattaacggcgaggcttgatatccaacttcaccggcttgatcatattctccgggcttaagatcgtatccaattcctccttggtcaagataccatgatccagtaccaattgataaacgctaacgccggtctccaacgcctccttcgcgatcttggtcgagttcttatagccgattaccggattcaaggccgtcaccacgccgatgctatgatgtacctcctcacggcaacgatcctcgttagcgataataccgtccacgcaacgggtacgcaaggtatcgaaaccattgatcagcaaatccacggactcgaagcagcattgtgccatcaccggctccatggcgttcagctccatctgggcggcttccccggccatggtcacacataattcattacccattaccttataagcgatctggttcatcacctccgggatcacaggattcaccttacccggcatgatagaagaacccggctgcatagcaggcaagttaaactcacccaaaccgcaacgaggaccgcttgccaacaagcgaaggtcattacatatcttattcatcttcacgcaaacccgcttcatggcggaagcatagcctaccaagcaagaagtatccgaggtagctcctaccaaatcggaggagagacggatatcccatccggttatctcacgtaaagccgcgatacatttctccgcgtatcccggctcggcacaaatacccgtaccgatagcggtagctcccatattaaccaccaagaaatcggcggcggcctcattcaagtgagcgatctcatcctgcaagatgctggcgaagccattaaaggtctgccccaacgtcataggtacggcatcctccaactgcgtacgtcccatcttgataatctgcgagaactcctctcctttcttacggaaagaggcaatcaattcctccaaatggggaagcaattgaagatgcttaaaatacataccgatatggatagcggtcggatatgcgtcgttcgtggattgcgagcagttcacatggtcgttcggtgagcagtattggtattcaccccgctcatgccccatcagctccaaggcacggttggcgatcacctcattcgcgttcatattcgtagtggtacccgctccgccttggatcatatccaccgggaactggtcgtgatgtttaccatcgagaatctccccacaagcggcgatgatagcgtctttttgctctacggtaagcaagcctaattcaaagttagccatggcagccgccatttttgttatagctaatcctttaatgaataaaggatattcgctcaaacggaatttactgattgagaaattctcgattcctctcaaggtttgaactccgtataatgcttcggcggggatttcacgagcgccgatcaaatcgctctctatgcgagtttttccagttaatttagtatccatattagaaatattaatcgttttttattgtttccgcaaaggtagaaactattattttgaaagcaaattattcttcgaaataataaaaacaaataccaaaaacgccaatacacgtctatacaaggctcaataaattacaatttgtcaacagagcagttttaatagaccttctgatcttttttatctcattcataaaaaaaacacgattttatttgctgtttgtcaaagattccatatatttgctgccgtaataacaaaacagagtcatgagaacattcgtagtaaatacatattggtggtggcgctccgtacaactcaaaaggtcgtaaggaacgaagactcgtatgtatatataaacactacataaagatataaagaggtctgtcgcacttgcggcaggcctcttttctttttatggcaaattcaaaaggaaaataactaaaatagataaaagatgaaaacgtatcaagttgacaagaatggttactatggtgagttcggcggggcctatgttcccgagatccttcatcaatgcgtggaaaatttacagaatacctatctgcaagtgttggagagcgatagcttcaaggaagagttcgatcagttattgcgtgattatgtaggccgcccctcccctctttacttggccaaacggttgagcgagaaatacggatgcaatatctatttgaaacgggaagacttgaaccataccggagcacataagatcaacaatacgatcggccagatcctcctagcccgccgcatggggaagacccgtatcatcgccgagacgggtgccggacagcatggagtggctacggctacggtatgtgccttgatgaatatggaatgtatcgtttatatggggaagacagacgtggaacgccaacatgccaacgtacagaagatggagatgctgggagctaccgtcgtgcccgtgacctcgggaaacatgaccttgaaagacgccacgaacgaggcgatccgtgactggtgctgtcatccttcggatacgtattatattatcggttctacggtaggcccccatccttatccggatatggtagcccggctgcaatccgttatcagcgaggagatcaagaagcaactgctggagaaggaaggaagggatcacccggattacctgatcgcctgcgtaggcgggggaagtaacgccgccggtacgatctatcatttcgtggacgacgagcgggtgaagatcgtcttggccgaggccggcggcaagggcatccactccggcatgagcgccgccacgatccaattgggtaaagagggcatcatccacggggcacgtaccttggtcatgcagaacgaggacggacagatcgaggaaccttattctgtttccgccggcttggattacccgggcatcggcccgatccacgcgaacctctccgtagagcaccgtgcgcaaatcctagcggtcgatgatgacgaggcgttggaggctgctttcgagttgacccgtttggaaggaatcatcccggccttggaaagcgcccatgccttgggagccttggccaaggtaaacttcaagccggaagacgtggtggtactgactgtctcgggccgtggcgataaagatatggacacttacattaattataaattatcatgaattattctttcaaaacgataagcaagaaggtgatgggcgaccttcacactcccgtaagcatctatctgaaagtgcgggatatctacccggaatcggccctgttggaaagctcggacttccacggaaacgagaatagcctttcctttatagcgctccgccccttggcgagcatcggtatcaacaacggggaatgcacggctaccttcccggacgagacccgtgaggttaccccgctcaccgaagactataacgtacccgaggcgatgaacgctttcctcggccgcttcaaggtggagggagcggacaagaaggtctgcggattattcggctacacggctttcgatgccgtccgttatttcgagaacatcccggtcatggaagttcatcacgaggagaacgacgcccccgatatgctatacatattatataagtatatccttgtcttcaatcatttcaagaacgagttgaccctagtggagatgctccaagaggacgaggctagccggctggaagaaatcgagacattgatcgagaaccgtaacttcgcctcctataacttccagacagcgggtcccgagacctccccgatcaccggcgaggaatacaaggcgatggtccgccaaggcatcaagcactgcctcaggggagatgtcttccagatcgtattgagccgtcgcttcgagcaaccgttcaagggagacgacttcaaggtgtaccgggctcttcgcagcatcaatccctctccttatttgttctacttcgatttcggaggtttccgtatcttcggctcttcccccgagacgcattgcaaggtaacgggcagacacgccagcatcgacccgatcgccgggaccgctttccgtaccggtaatatcgaggtagacaaacaacgtaccgaggccctgctagccgaccccaaggagaacgccgagcacgtgatgctggtagacctcgcccgcaacgacctaagccggaacgcccacgacgtgcaagtggatttctataaggaggtacaatactacagccacgtcatccacctcgtatcccgtgtgagcggcgagatcaacgccgatagcgacccggtaaagacctacgtcgataccttccccgccggcacgttgagcggagcccccaaagtacgggccatgcaactgatcaccgacatcgagcatcataaccggggtgcttacggcggctgtatcggctttatcggtctggatggtgatttgaaccaagcgatcacgatccgtaccttcgtcagccgtggcaacgtactttactatcaggcgggagccgggatcgtggctaagagcaacgatgagcgtgaattgcaagaggtaaacaataagctgggagccttgaagaaggcgatagatctagcggagaaattaatcaattgattatccggttgtagagacggggcgtgccccgtctcccacagtctgatagtattttaagttaccattttgaaaggatgagacggggcacgccccgtctctacaacaacaacaatatatataaaatgaagatattattatttgataattacgattccttcacctacaatttgctacatatattgaaggaactgggtgcggatgtagaggtacaccgcaacgacaagatctccttggaagagatagagcgtttcgataagatcttactatccccgggaccgggcacccccgaggaagccggcatcctcctccccttgatccgccggtacgccccgacaaagagcatcctaggtgtctgcctaggcgagcaggccatcggcgaggcattcggcgccacattgataaaccttaccgacgtgcatcacggcgtttgctccgatatacggattgtcgctaaagatcctatcttcgagggactggaaccgggtatacgtgttgggcgttatcattcttgggcggtctccaaggaaaacttcccggattgtctggaaattacggcggtcgatacggaagaaggacagatcatgggcttgcgccatcgtgagtacaatgtacgaggtatccaattccatccggaatccgtgttgacacccaaagggaagacaattatagagaactggctgaaacgctaattacctcctaaggcacttatagtttcttcctaacgaaacatcagtttctctatggtgaaactaatgtttctcaagcaagaaacaagagttttcccctagagaaacaaaagtttttcgataaagaaatatcgcaaaactgcaatattttatcattcaacacattacagacatgaagcaaatattatacagattattcgagcaccaatatctaggccgggaagaagcccggaatatcctccagaatatagcggagggacgctacaacgattcccagatcgccagtctgatcaccgtatttctgatgcgcagtatctccgtagaggaattgaccggattccgggaagctttgctggagatgcgtgtaccggtagatctaagcgaatacaagccgatcgatatcgtaggtaccggaggcgacgggaaaaacacgttcaacatcagtacctgttcctgcttcgtagtggccggtgccggttacaatgtcgtaaagcacggtaactacggggctacctcggtgagcggcgccagcaacgtgatggagcaacacggcgtaaaattcacgaacgatatcggtaaactacgtacctccatggatacctgtcatatcgcctacctccacgcacccttgttcaacccggcgctgaaagcggtagctccggtacggaagagcctcggcgtgcgcagcttcttcaatatgctcggcccgctggtcaacccggtcatgcctacttaccaattgttaggcgtatataacctcccgctactccgcctatataattatacgtaccaagagagcggcactcgctttgccgtggtacatagcttggacggttacgacgagatctccctcacggccgatttcaaggtagccatgccggagaaagagaaactttataccccggagatgctcggattcaaacgttgcacggaagcggacctcgacggcggcgagaccccggaggaagcggcccgtatcttcgacgccgtattagggaacaaggctacagaggcccaaaagagctgcgtgatcgccaactccgccttcgccatccaagtgatctgtcctgagaaaaagatcgagacgtgtatcgccgaggcacgtgaatcactggaaagcggaaaagcattggctacattccgtaaatttatatctttgaaccattgataaagaaacatatcctatgaaaaaggacatcttacaagatattatcgccaataagcgcatcgaggtagcccggcaaaaacaggccgtaagcttacagaccttattggctctaggtagcgaccgtatggagcgtgacacacgttccatgcgtgcggcgctggaatcatccccctccggtattatcgccgagttcaagcgtaaaagcccctccaaaggctggctgcatccgggtgcgaatatcgccgacgtggtgcccgcttacgaggccggaggagcctccgcctgctcgatccttacggatggggatttcttcggaggttccttgggcgacttgcaaaaggcccgcaagctggtggatctcccgttacttcgcaaggacttcatcatcgatacctaccaactcttccaagcccgggtgataggcgccgacgctgtcttgttgatcgccgccgcccttacagaagaagaatgccgggtactcgccgagaccgcccatagcctgcaattggaagtcttgctggaagtccatagcgaggacgagctcaaatacctgaatgcggatatcgatatgctcggcgtgaacaaccgcaatctcggcaccttccatacggacgtaaacaactcattcaagttggtcgataagatgcgaggcttctcccctcttttagtgtccgagagcggaatctccgagaccgataccgtacgccgattgcgtgaggccggtttccgcggattcctgatcggagagaccttcatgaaaaccgagaggccgggcgataccctagccgattttataggaggactggcatgatcatcaaagtatgcggaatgcgagactcccggaacatccaagaagtctccgccctagccgtcaactggatcggcctcatcttctacgaacgctccccgcgcttcatcgggcaaagcccgacgaagcagtggacagtggacagtggacaattgacagttaaataccgcttgtcgcaactgtcaactgtcaactgtcaactatcaactaaaaaagtgggcgttttcgtcaacgctaccatcgagtccatgatggagaaagcctccgcctacaagctagactatctccaacttcacggtaacgaatcgccggaagattgccacaccttgcaaaaaaggggctattccttgatcaaggctttccccatcgctacgaaagaggacttcgaaaaaacaagggagtatgagggccgggtggattatttccttttcgatacgagatgcgagggctatggaggctcaggcaaacgtttcgattggtccatcctaaccgagtataaaggagagactcccttcttgctcagcggaggcatccgtccggaaaacgcagaggcgatccggaacttccggcatccccgtttcgcaggtatcgacctcaacagtggcttcgagattgagccgggattgaaagacgtcgacaaactaaagaatttcatccaacaaattttacatccagctgtagagacagggcgtgccccgtctcccaccgtctgatagtatttttaaaatagaattcaaaatgaatcgcatcacaaacttattccagacccagaaagacggaatactctccgtctatttcaccgccggttatccgaacttaaacgatacggcaagcatcttaaaagccttacagactaaaggtatccacatggtagaagtaggaatccctttctccgacccgatggcagacggccctgtcatccaagaggccgccacgcaagcgttgcgtaacgggatgtcactgcatctcttattcgagcaattgaaagagatccggagcgaagtacagatcccgatcatcttgatgggctacctgaaccccatcatgcaatacggtttcgagaaattctgcgagagttgcatagaggccggcgtagacggaatgatcatccccgacctgccttatgccgattatatctccgactacaaggagatcgccgatcgccatgacctaaaaatgatcatgctgatcaccccagagacctccgaggaacgaatccggctgatcgatgcccataccagcgggtttatctatatggtatccagcgcagccacgaccggagcccaacaagacttcaacgagcagaagcaggcctatttccgtcgtatcaacgccatgaacctacagaatccccgcttggtaggtttcggcatcagcaataaagccactttcgaggcggcgatagcccattcttccggtgccatcatcggcagtaagttcgtacagttactaaagagcgaagctactcccgccgaggcggtcgataagttactggaagccctaaaacaataggaaccctattcatgtttacatataaaaacagtaaatagtcctatgaataacttcacttttcacaacccaacccgtttattattcggtaagggcatgattgagaaactgagtacggccatcccgatggtgcatcgcatcatgatcaccttcggaggaggtagcgtaaagcaaaacggtgtgtacgaccaagtgatcaaggcgctaaaggatcgtgactatatcgagttctggggcatcgagcctaatcccaccatcgagaccttgcgagaagctatccagatagcgaaaggcaagcaggtggatttcctattggcggtaggcggtggctccgtcatagacgggacgaagctaatctccgccggcatccagtacgacggtgatccttgggaattggtacagaaagggtattactatcataccgtgcccatgggtaccgtactgaccctgcccgccacgggttccgagatgaatagcggggccgtgatctcccggaaagagacgcaagagaaattcccgttctacagtaatttccccgtgttctcgatcttggacccggagacgaccttcagcctgcccccgtatcaagtggcttgcggtatcgccgataccttcgtccacgtgatggagcaatatatgactacgaccgaccaatcccgcttgatggatcattgggcggaaagtattttaagtaccttggttgagatcgccccgaagattaaggaagatccgaggaattacgacctgatggcagatttcatgctatccgccacgatgggcttgaacggctttatcgctatgggcgtaacgcaggactgggctacccatatgatcggacacgagctaaccgcccttcacggattgacgcatggagcgaccttagcgatcgtcttccccggaaccttacgcacccttcgcaagcagaaagagggcaagatcctgcaatacggcgaacgggtatggggtatcaatagtggaacgacagaagaacgggtaagccaagccatcgagaagactgagcaatttttccaaagcctcggtttatctacccgcctcagccaagagaagatcggcgatacgacaatcaccgagatcgagaatcgcttcaatgaacgaaacgccgccttcggggaggcgaagaatgtaacgggtagcgtggcacgggaaatattggagagctgtaaataacgtacaacttgtagagacggggcgtgccccgtctctacaaatgggtataggttttatcttaacaggactactacccggatcgggccatgcgccccgaataccaaggcttgttcaatatcagcagtctttgagggaccggacatgaagactccgtaatcataatccatagtggcagtacggcggtaagcctcattcatcgtatgaaccaattgagtcttgtccaacaagatcaccaaagcgttcgagataaagtacagacctttataacgtacctgacggggtaaccagacagcggcattctccgccacgccgaaactaccctccaccacagatacgtccgttccgttcaactcccggggatcggtcagcccatctgggttaaaggtagcgcaagtaatctccttcaaattcgaggcgatacgtttcgcctccggaaactcacggcggatcacctcattcacatcctcgccgggctttaactcgatggccttgccacccgccccggctaacacctccgagaacgtagccaacttatccgcataggtaatcgcctccaacgtaagctcaggcatctcgtggcgtgcacccgtatgacgacggatactcgccaatatagaatctttactactcattatctcaccttattattcttccacatatcattaaacgactccttggcgaaagccggaagctcacgtcccttgccccaagcgttcaagccattgtagaccatgaaacggggcaaatgattcactaccggagcaaacttcaacgccgtattgaacaatcccggacgttccatcaagaacttcatgccgaaagacatcactttcttctccttgctcgccttaccgatcttatccaaatcttgccgccaacggtaaatctgctcgcccaaatcgatctttaccggacaaacgttcgagcaagaaagacataaggagcaagccgatacgttatccgaatattcctccggattcctcagcatacccaagttgatcccgatcggtcccggaatgaaatacgtatacgaatagccaccactcctgcgatataccggacaggtattcatgcactcgccacaacggatacaattcaacgtacggatatgatccggtttcgccaagatatcactgcgcccgttatccacgataatgatatggaactcttgtccctcgggcggacggcggtaatgagaagtataagacgtgatgggttgccccgtacccgaacgagccagcaaacgagtgaatacgcccaatgcctccagattcggtacgatcttctccatccccatcgtagcgatatgcaccttcgggaaggaggttcccatatcggcgtttccctcattggtacaaaccacgatctcgcccgtagaggcgacagcgaagttagcgcccgtcatcgccacgtcggcatgcaggaatttctcacgcagattcttacgggcggcatgcgtcaggtaggtagggtcgatattccctttctccgttcccatctcacgctccatcatctcgctgatctgctcccgtttgatatggatcgccggcatcacgatatggctcggggccaaatgcatcaattgcaagatacgctcacccaaatcgctctccaccacatcgattcctttcgacatcaagaactcgttcatatggcattcctccgtcagcatcgatttgctcttgatcaggttccgggcatcatgctggcgcaagatccgcaagacgatctcgttatgctcctcggcatctttcgcccaatgcacgatagccccgttggcgatcgcatttttctcgaactcctccagaagcgtgtccagatggctgttggagtaaagcttgatctccgaggccaactctctcaaccgctcccactcgggaagcgaatggctcatcttatcccgtttggtacgtaccatccaaagcgtatggtcgtgccaagcctcattctccttattctctaggaaacgggccgctgctatagcatgtttcgtactcataatccggacgctaatatttgaacgatgtgaatagtcttgatcggaagtttctctcgcttgataaccccttccatatgcatcaggcaagagctatccgccccggtgatatactcggcgccggtactcatatgatcctttaccttgtcttgtcccatgcaagtagagacctcaggctcctcgatggcgaacataccgccgaaaccgcaacattcgtccacccgcttcggctcgaacacctcgatacctttcaccaaggaaaggagatcacgtaacttggaatagtacgggatattacgctcgctgggcgacgagagatgcaactcacgcaccccgtggcaactattatggatactcaccttatgcgggaaaacggccggcagggatcccggtctcaccacgtcgtgcaagaactcgcagatatcataaatcttcttactgttcatacaaacgtgatcccgctttcccaatatatggggatggttctcttttacgaaggctacgcaactggccgaggggcctaccacgtagtcatagttcttaaactgttcctccatccggagggccaagcgagccgcctcatcctcgaagccggcgttcgccatgggttgtccgcaacaggtctggtccatcggataatcgacatccacacccacatgcctcaacaatttatacgaggcgatacccacttcggggtacaccgcgttaatgtaacatgggataaataatcctaccttcatactaattttatcttatatatcatatacgacaccgtatataattaacacctacaagcccctcatagctgcatattggcccttaccctgcttaatgtctcgggagtcatcagcaaataagaggcgatatgggacaagggggcacgctgcacgatctcagggtgttctttcaataagcgggcataacgttcattagcggtctcgaaacgaaggaaatccgccttccgttgagacaggatcagcgaattctccaacaggcggcgatacatgacctcgatctcgtaatcctcggcgcacaatgccaataaaggatcatgaggaatgccatacagcaccgtattctccaaggcctccaccaacagattagcgggacgctggcgcaagaagctctcgatgcaaatgaagatgttgtcctcgctggcgaaatgctcggtcagctctttcttattcttgaagtaaaactggcgaaccattcccttatagacataaccgagttgcgtacaaacctctccttcgctcaaaaacagggcgccttttttcaattctgtccggattaagatagaggccagtttctgggcggcttcctcactgagtagaatcgattgcgccgcaatcctgcgagctataaatatcgctgtatccatattcatggttgtttttgtttgtttccgcaaacttacgaaataaataccacttgatttacatcaagcccccatttatttatattcctgccaactcttgatgcagatatcatctacgctcaaggtacagaaggcttgaatgaaagcgctcgccagacgggcattcgtaatcaacgggatattcaggtcgatggcggcacggcggatcttatagccgttgtcaagctcgccggcggaaaggtcacgagggatattcacgaccatatcgatctgcttctcatgaagcatcttaagcgcctgcggttctcccttctcgctcggccagtacaccttcgtactcggaatgccattctccgccaagaaacggtgcgtacctcccgtagcgaataggttgtagcctttcgtcgccaacatcttagcggcatccagcatggctaccttctgcttcggcgtaccggtggacaggaggatattcttctccggaacccgttgcccgacagcgagcatactcgtcaacaccgcctcggatacatcgtcgcccagacaacccacctcgcccgtggaagccatatcgacccctaataccggatcggctttctgcaagcgattgaacgagaattgagaggccttgatacccacgtaatccaaatcgaactcattcttattcggtttctctaccggcaagcccagcatgacacgggtagccaactcgatgaagtttatcttcagcaccttgctcacgaacgggaaggaacggctggcacgaaggttgcactcgatcaccttgatctcattgcccttcgccagatattggatattgaacgggccggagatattcagctccttagcgatctgcttactgatacgcttgatacgacgaaccgtctccacatataatttctgggccgggaactgaatcgtagcgtcgccggaatgaaccccggcaaactcgatatgctcgctaatggcatacatcacgatctcgccatgatcggccacggcatccatctccacctctttcgcatgctcgatgaactgacttaccaccaccggatgcttttggctgacgttggcggccaatttcaagaaacgctccaactcctcttgattcgagcagacattcatggcggcaccactcagcacgtaactcgggcgaaccaacacggggaagcctacctccgccacgaagccattgatatcctccatggaagaaagctctttccagcggggttgatccacgccgatacgatccaacatggcggagaacttctcacggtcctcggcattatcgatgctcttggcggatgtccccaagatattcacatgctgctcgtccaaacgcatcgccaagttattcgggatctggccgccggtggagacgatcacgccgtgcgggttctccagctcgaggatatccatcacacgctcgaaggtaagctcatcgaaataaagacgatcgcacatatcatagtcggtagacaccgtctcgggattgtagttgatcatcacggaacgatagccctccttacggatcgtattcaaggcctgcacgccacaccagtcgaactccaccgagctaccgatgcggtaagcgccggaacccagcacgacaatcgagcgatgatcgcccaaatacgtcacgtcgttttccgtaccgctatacgtcaggtacaggtaattcgtctgcgccggatactcggcggccaaggtatcgatctgtttcaccaccggaagaatgccatgctccttacggaactgacgaaccaacatcatacccttctccacatccccgtcgagaccgatcgcccgtgcgatctggaaatcagagaaaccttgtatcttcgcccggcggatcaactccggattgatgcgccaacgttggatccccttcatatcgaaagcgtgaagctccttggaggtctgcatgattccatatagtttctgtaggaaccatcggtctatcttggtaagctcatgaatctggtctaccgtatagccagcacggaatgccttcgagataacgaagatacggcgatcggtaggctcatgcaaagccttatcgatatcctcgatcaccaactccttattctccacgaaaccgtgcataccctgcccgatcatacgcaagcccttctggatagcctcttcgaaagtacgtccgatcgccatcacctcgccaaccgacttcatgctggaacccaactcacgagccacgccgtggaacttacccaagtcccagcgagggatcttacataccacgtaatcaagagccggctcaaagaaagcgctagtcgttttcgtcacggagtttttcaagtcgaacaaaccgtaacccaagcctaatttagcggccacgaaagccaacggataaccggtcgccttagaagccaaggccgaagaacggctcaagcgggcgttcacctcgatcacccggtaatcctcactctccggatcgtaagcgtattgcacgttacactcgcccacgataccgatatggcgaatgatacggatcgccaactcacgtaacttatgataatccgtattgctcaaggtctgcgagggggcaatcacgatagactctcccgtatggattcccagcgggtcgaaattctccatgttacataccgtgatacagttatcgaagcggtcgcgcaccacctcgtactctacctctttccagcccttcaagcttttctccaccaatacttgcggagagaaagagaaagccttctctaccaacacgtccaattcttcctcattgtcgcagaaaccggaacccaagccccccagcgcataagcggcacggacgatgaccggataccccagctcggcggccgcacggcgagcgtcagcggcattctccacggcctcgctcttgatcgtcttcacgtcgatctcatccagcttgcgtacgaacaactcccgatcctcggtatccatgatagcctgcaccggggtacccaataccttcacgccatacttctccagcacgccgctttggtaaagagccacgccacaattcaacgccgtctgcccgccgaaagcgagcaagataccttccggacgttccttctcgatcaccttttccacaaaaaaaggagtaacgggcaggaaataaaccgtgtccgcaactccttccgatgtctgtaccgtagcgatattcggattgatcaataccgtttgaatcccctcttccttaatcgccttcagggcttggctgcctgaataatcgaactcgcccgcctcaccaatcttcaaggctccggaaccgagtatcaggactttctttatatcttctttcattgctttacttttttaatgttctcttttagggtaagcctaaacacccgtttagggtagacctaaacactcatttagggttgccctaatccctcgtttagggtgggcgtaaatccccggctacaacaattccgtgaatttatcaaacatgaactccgtatccagcggcccgctgcaagcctcgggatggaactgagaggagaagaaaggcttcgtcttatgcttgataccctcgttcgtcccgtcattcatattgatgaacagcggttcccactcctcacccagcgtatcgttatccacggcgtaaccatggttctgcgaggtgatgaagcatttctccgtgcctaccatacgtaccggctggttatggctgcgatgaccgtacttcaatttatagatagaagcaccgccggctttcgccaacaactggttacccatgcaaataccgcaaatcggcttatccccggaaagcgccttacggatattccgcacggcggcatcgcaagtatccggatcgcccggaccgttgctgataaacaagccatcgtattccagctgattgaagtcgtagtcccaaggcacacggatcaccgccacgttacgcctcaacaggcaacggatgatgttatgtttcacgccgcagtccaaaagcacgacacgctttaggaattgagaattgagaatcgagaatcgagaattggaggcttccgataaagaacaggcctggctcgtaccatcgggcaggtaacaaataatctctttgcacgatacccgatccacatagttcacatgctcataattctcgattttcaattctccattttcaatttcgttatcggcatcgccgataacgatgcgtcccatcatcacgccatgctcacgcaatttcttagtcaacgcacgcgtatcgataccgtatatgcccgggatcttctcctccttcaaccagtcgcccaagctgtactcggcgttccagtggctatactcatggctgtaatcgctaacgataatcgcctcggcgtggatcttctcgctctccataaacgtagcgatcccgttcggctcgaacgtacgaggcgggacaccgtagttaccaacgagcggataagtcaacaccatcaactggcctgcgtacgaagggtccgtcaagctctccggatatccggtcatagcggtattgaacacgacctcgccagccaccggtctctcatagccgaaaaagtagccacggaagacggtaccgtcgtctaacatcaaagttgctgttctgtttgtctgcatagaatctgtatgttgtgtcatttcactaaatattcttcttccatatagtgaataaaagcctcgttcactaaccgagtcccgcccggtgtcgggtaatcgccggagaaataccagtcacccggatgctccggacaagaggcatgcaagccctccaaagtctggtagacgatctctactttcgcctgtgtcccggccggtgtaagcaactccaccatcttaacggatatctcctcgtccgtaaacggggcgtatatctcctttacgtaattcaccaacggaccatccgccgctgtttgttgtcgcttcgccttctgataagcgtccaagatcacgtattccatcccccggtcacgtaacagggccaccgcggccttaaaagcgataaactcgttcatccgggacatatcgataccgtaataatccgggtaacgtacctgcggagaagaacttacgatcacgattttcttcggatgcaggcgatccaagataccgataatactctggcgtaaggtagtaccccgcacgatgctatcatctatcacaaccagattatcgataaaaggttcaatacttccgtaagtaatatcatacacgtgcgccgccagatcattgcggctattgccctcagcgataaatgtacgtaattttatatcttttatagctactttctccgagcggattcgcatggaaaggatttgctccagttcctcttccctgagcaagtgactacgatcggcgatccattcttttttcagcttattcaaatagttgttcaatccctcctgcatcccgaaataagcgacctcagccgtattcgggataaaagagaagacggtatgattcaaatcataatccaccgctttcaagatcggatgcacgagattatctcccaaacgcttcctttccctgtaaatatccacgtcgctaccccgtgagaagtagatacgctcgaaggaacaagccttattctctttcggctccacgatctgggagatatgccactcgcctttcttgttgacgagtatcgcctctccccgattcaactcccggatatcctctacctgcacgttcatcacggtttgtataaccggacgctcggacgccaacacgataatctcatcatccgcataatagaaggccggacggattccccacgggtcccgcacgctgaacgactcgccactaccggtgataccgcaaatcacgaaaccaccatcccagcccggggtacagcgtttcagcacgttcgacaaatcaatttgatcctcgatggcatgcgtgatatccatccctctcaatccttccgcctcacacttttggtacaggcgctccacttcccggtccagccggtgtcccagctgctccagcatgatatacgtatcggaatatttccggggatgctggccgatcgccgtgatctcctcgaatacttcatgaacatttgtcaggttgaaatttccgcaaacggcaaggttctttgcacgccagttattgcgtcgtaaaaaaggatggatataagagattccggattttccggtggtactgtaacggaggtggcccatataaagttctccggcgaaaggtaggttggctttggcgaatagcggatcgttgagttgctcgggggttaaatccttgtagtgttcgtgaactgcggcaaatatctcggtaatagctccggtcccgacggcccgttcacggaacatatattcctctccggcatttgcctctaacttcacgcaggctaagcccgctccttcctgccccctgttatgctgcttttccatcagcaaatagagcttgttcagtccatacatccaactaccgtacttctcgtgataatactccaagggtttcagtaaccggaccatggcaacaccacactcgtgcttcaatacttccattgtcgaatcaactttttgattttgccgcaaagatacagacaatacctaacatattgtttaaacaaacataaaataattgacactttcacggaaaaaatgtttttatcggacgtttggttaacaaagcttacattttataagcaaaagggagcgttttattttcaatccataagccactcatttccctcttgaaagaggcctttcaaagatatccatccgagaaccgtaatatttccgtaacagaaagaaaaacaccaatattctttctggcacagaaatattcttgcataaattctttctatcatagaaataattcggtaattttgtgcgtaaatataatttccatagaatgaatacaaatatactccaaacactggtaacggccatgcaacgccgattagcggctcttccgcagagattgcgaccatttaccacggagtttgatgagctccctaaaaacctgatgctaaccggtgccagaggatgtggcaaatctacatttctactccatcattcacaaggcaggcgcttattatacttttctgctgataatccgaagattattggcgaaccgctctatgacttagttagtagcgtattcatgcttggttatgaaggtgttattatcgacgagattcactacgcatcaaactggagcatacatctgaaggccttgtatgatgactatccaggaaaaatcatctggatttcagattcctcatcgttagtacttcgtgatggcaaagccgacttgtccagacgttatgtagcgatacagatgcctttaatgtcgttcagagaatttctatatcttgaaactggccaaatataccccaagtataaactgggagacacaatactacctacacaaccagatgcggagctgttgaaccatttcctcaattatcgtagttacggtacacgtcctttctaccaagagaaagatttcgaagcacgttacatggctatcatcgacaaaattctcaataacgatataccgttcttcctgcctagcatttccgaaaacaacctacgtgtgatgcgagccattatcggcacactggcaaactcctcaatacctcgtgtacaagtcacctccttatgctccgactggggaataggagcggaaaaactctatcaactactctttgtgatggaaagtgtagatctattgaaaatagtaaagtaccccaatgacacgaaagcccgtagcactggcgcaaaaatgttgttcgcagccccatgtgcttataaggttttgaatgcagaccaaggaacggaacgtgaagcctacactgtccactgcttttctagggcaggttacgagataaacgccatgaaagacgagaagaaaggtgattatgtgattacaaaagaccatgtatcacaaaccctagaagttggaggaaaaaacaaaaatcctaaagaagcggactatgtcttgagagacaacaccgactaccctgtaggcaacgccattccattctggctcatgggtatgatgtggtagtattatagtcatcacctaaaaaaaataatcaccccagccattcgtctccccccttcaaaaaggaaatgaatgtccaaggtgattatttttaagtttatcagaaaacaagaaaatccctatcttccccactcctttatcatctgctcattctgcaaacgacaaatcaatagttgcccattcttttcagctacgatataatccttaagtccttcaatcacaactttgcgctcatccgaggtgtgcacaacacatccagcacaatcgatcatccgtacctctgaccccacggctgaattcccatccatatcttgaggtaacaaggaatgtagtgatccccagctacccaaatcactccagccaaactcagcagacagcatataaacctcttcagctttctccatcaccgcataatctatcgagatcttttcgcaagtagggaatagttctcctattactcttttctcatcatccgtataaaagcttaaactcatcttgtccatcactctcgccagttccggtgtatatttacggatagcctccataatcatgtctacatgccacacaaagataaaagcattccaaaaataatgaccatcagccaagtaatcttctgccccctttcggttgggcttttccttaaatgcctcaacctttacgacctcattctttatagaggaagaaaatgtttttatatatccatacccagtttctggtcttgaaggtttgactcctatcgtcacaatcgccttccgctcttgcgtgaatgaaagagcctgcgcaatcacctttcgaaatccaatcacatcgatcaccaaggcatctgaaggtgttacgacgatattggcattagggaacctacacttgatcttccagcaggcataagcgatacaaggagccgtgttacgagcctccggctcagcaagaatattatctagcggtatttccggtaattgttgctgaacgatccccacatactgttcacttgtcaccacccaaaaattactcaagggacacaatgaggaaaaacgttccacggcaagttgaatcaatgatttccctacacccatcacatcaataaattgcttaggataatcaggcgtgctcataggccaaaatcgagaaccaatacctccggccatgatgacgatatgtgtgttgtttgtttgcatatatatttaaagaattaatttcagcgaccaaatacgaatgtcatcgcaaaagatttacctatctttacataaagataattcataaatactaatataatcaatgacagtatcggagttaatactaaatcggtaaagtatttatcaagattatctaaatccagaaaaacacctaaaacagtttcaagaaagaaatactgaaagacatagatatacaaagtatttttacccatataagaaatatatctacccaacttagaagattgaaagagactagacctcattttaaacaaacaaaacagaaacactgaaccacaaaggccaattattattttataaaataagacactaaaataatgcgttaaagaagaagaagtatcaaataaaacaaaaggacctaaatgttcataatatattttaagatactcattattccaaaaacaaaacagaaacaaaaatacggtggctgataaaaacgaaacaagacgaatcttacgatagactaatctttcaaattcacgaaggaacgtaccaaataaaaagcaaatgtacatttcattaaatttataatagacgacaaacagactcagtactattgtaaaaaatagaacatacacattcttatattttgcatatggataataaaacacaaagcacaagaatatagatttcaaaaaccataaacaataaaaatatttacctaaaagactacctctatatatatatatatacgaacataaaaaaccataaattatacaaggaaatatcaattgaataaatttcttttttagaaacttcccaaaagaatactttgcaatattgcccgcaaagaaacctgatatcatcataaacaaaggcatatgaaaagaatagatacctatatgtatatcattttcaaggtaatccgtaacaccatattgaataacgtgtccccaaatcactaaaaacatcgcaaagcatttaagagcatccaaccataatatacgattcaaactaacaggatcttgcttaatacactccatacaactaatatttttattttatatacttcataaaacccttataagcaaaaatcagcataaagtaaatagaggggatccatttcacaccctctaccttccggagtacgaaccactgttgggcgaacatcttccatttatttcctgaacgagaattcacagcctcacgatacaatgcatgtatcttacccgtgttataagcctttacccctttacgcaaaatctctagccaaaaggcgtaatcttctttgggaatcgatcggaagcgagtctgctcgattaactccctatgcaacaatactgtcaagcagggaatctcattactctctagtatatcccaataagtagatacactcctaacccgaatccaccgatcagccctagctccattccacgacatcttctcgtagtctgaataaacaaagttataagaataagcctccatgaacgccacctgctcttctagtttattaggaaaccaagcatcgtcactatccaagaaggcgatatattcgccctgcgcttgttgaagtccaatattccttggcagcgacggactgcccgacggattctccgtcctcaaataccgaattcttgtgtcacgttccacatacgtttgaataatttcagctgatcggtctgtcgagcaatcatctacgatcaacatctcccaataaggataagtttgagataagacagattcaatcgtttgggtaataaaaggagaagcattataacaaggagttataatagatataagggggttcataaaataaaagtttagtaagcactttatttagcccatatgaggcacttgtttgtgccccaaactgagtttaatcataagaaagtatatcttatctaattatctgtaatttaaaaatttacaaataggcacatctacatcgattcaccgctcagtcgcaaaattaacgccaaacctactcaaaatactttttagcgttctccgttgcctaggtgatattttccactgaagccaattagtcatatcaatctttatctgttgagagagaggaacaacgcctctaccagaatctatatacaagctcaatccactcaaactttcaacagcatgcctaatccatttacctttatatactccatgtatatatggcaagatatattctgaaactgccaccacatctttataatcctctgatggagcaacagcggcttgttcatttattgagttttcaatatcccatgcgctaagagagccatcacctaacagctcaacaaaaagatcctttcgaaatattccaaattgaagattgatagcataggggatttgcttattgacactacgcaataaaggaaaagatttaattttagatcctttaggagtagggcctaaattacaataccttatctcgtggctatccatatagtcaagtaaccgctctattaatgaattgtcaacattgtcactcaagataatgtcatcacacatcaacattacatacttcgattttataactggcaaagccgctatagtacgctcaacccaagtatcattttgcttattattgcatatacaagtaataccttcatacgatttggtattggtggttagaataaactcatagggacaatcactccaatatctccgatatccttttaaaaatacggcaagcacatcagaatacgaatccggagaactaacataaatagaaagtcgcttatccatcagctattttactttttctatatattccttcaaactcatcaagtttttatccttgtcagaaatgatcaatttctcaataccgccaatcttaccgaaaggccactctatagccatatccggatcattatacattatgccggcatcaccttcaccataaaacacctcaccacatttatagctaacgacagaatcctccagcaccaaatagccgtggccaaaatactgaggtatgtatagagccttctgattctctccggtcagatcaaaaccttgccatttaccaaatgttggcgaatcagggcgaagatctatgattacgtcatacacatggccacttatacaacgaacaagcttggcttgctgtttaacaagctggaagtgcatcgcacgaattacaccctttttactaatggtatagaacacctctttaagttcatgatctataccattttgcttaaatgcatcaatattgtaatccttgataaagccaccacgttcgtctgtggcatagaagggagttatctcatatgcccccttcatatcaagttccttgaattcaaatttctgtatcatgactaattccgctataacatcaaagagtttttaagccaattaatagttttatcaatgcctttatcaaagtctatagacgcatattctccaatagtactaaccaagttactattgtcaaacatatccattgtatactttacaccatcatcttcacggactcctatccctaccttatctgcgcaaccaactagttctcctatacgaataagataatctttcaagactctaggattgccagagcctatataatagaacggcttattcgtttccttaaagcctagacgatatacagcttctataagatcatccacataaataaaatcatatggttgtaaagctggaccaaatgcggcttctttaccagccatcaactcacctaacgtataactaaccaaattgcccgttttattacctacaccgtatatatttgagaactgcatccacacaaactgttgagcgatattcttgcaataatcttccaaaattattctgcaagcatgcttagccacaccatacatcattccaccagtcgtttttttcagatgcgacaaactaaatgctacattctccgctacagtacccgcacaaagaaattttttcacatttagcctcttgcaaatattagcgcaatctactgccatctgaatatttgataattgaaccgtaggatctgctttatcagccccatttacacctttccacgcaaaatgatagaaagagtcatattcaattactggcagtctttcgactagagatgtattcacccctgattctatcctcgtaataagatttgaatcaggcaaacgattgccatgaaaggtaatatcaacagcaacaaccctagtacctttttctatcaatttctttataagtgaactacctataaaaccattgccccctgtgacgattacgttcttcatattatcgttatacgtttaaaaattcatctatctgtttatccatacaaacacgaacatccccacctgctagccaaaccttactccattcaacaatcttttccattgcctcatccagattccatcgagggctccatccaaaagtctttttcaatttagagcaatcaagcttcaagaaattagcctcgtgaggaccaccgtcatacttgttcacccacctcatgccttcgccccacttgttcacaaatagctcaacaagagcgcctgtttgaaaacaatccacatcatcgggacctacattataataatccgcaaaaccgatatcctcatattgcttcatcgctatcagcaggtaagcatacaaaggttctagaacatgttgataaggacgggtagagtatggattacgcacaacaatatcctcatgttttacagccgcacggatacaatcaggtactattctatcattggcgaaatctccaccacctatcacattacccgctctagcagtagaaataggaataataggcagaccatcaatatctgtaaagaaagaacgcttgtagctatgagtcaccagctccgaacaggatttggaatttgaataaggatcatacccatccaattcctcattctccctataaccccaactccactccctattcaaatacactttatccgtagtgacattcaagaaagacttcacgcaacaattattgcgaacacactcaagaatattcacggtacccatcacgtttgtctcgtaggtataggcaggatctttataagaatctctaacaatgggctgagcggcaagatgcagcacaatttctggttgagactcatcaaaagccttctttagagaggcataatctcgtatatcgccaatcacggaatgtatgtcatcttcaatattggcaatttgaaacaacgaaggctctgttggggcttcaagtgaatatccggtaacgaccgctccggcattagcgagtatcctacacatccaagagcccttaaagccggtatggcccgtaaggaaaatcctcttgcctttataaaaatccaatatatttcccattcgtatgataacttattattttgcgtaatctggtatttccggaacagagcgctcccaacgcttccaaggagctttatcctcggcaagcagtttttcaagcatagatttttcacgtatattatccatgcactgccaaaaaccagtatggatataagacatcaactgaccctcttgcgctaacctgacaagtgcggtcttttcgaagacacaagagtcacccccttccagcatatcaaaaacctcgggttctaacaccatgtaaccggcattaataggagcgccatcagaggcgttcttttcccgaaaagcccttacggcttgatctttagtaatatctaagactcctttatcttgtgctatcttgacggccgtaagggtcgcaagcttaccatggctcttatgaaactccaccaatttatcaatttctacatcacaaacaccatcgccgtatgtcatcaagaaagtctcgttctctatatatctctggatacgcttaatacggcctccagtcatagtgttgtagcccgtatcaacgacagtgactttccaaggctccatattagtttgatgaacggtcatttcgttgttgccaccacgatagtcgaaagtcacatcagagttatgaaggaaatagttggcgaaccactccttaatatattcctgtttataaccggcgcaaatgataaactcggtataaccataataggcatactctttcattatgtgccacaagattggcataccaccaatctcaatcattggctttggcttgaactgggattcctcagatatacgagaaccaaaacctcctgcaagaagtactactttcattgtaataaatttatagtattgtaatcaatgcattgtcttaaattagacatacaataacctaaacatcagaataatatcaaaaagcatctataaaatctctgaacttattttcaatcaccgaagtctcatatttttcagaaaatagctgataagtatatggattaaacctgttatcagaaagagaatttatagtatgaataaactctgatggcgtattacatttcccccccatacgacaataatcacattctataccctgaaaagcttcatcagtacctatgatagacttaccaaaactcatcgcctctatcactttcgttttcatacccgaccccttaaatataggggctacaacagctaacgcacttttataatatgaagataaatcatctacatatccctcaagtttcacattagacagagttttatttcttaaagtaggattattacaacaagccccaacaatgcgtaaatccaattggataaaaggggatacatgttcaataaaccatactatcccttctatatttggataaaaatcagcaccaacaaataataaaaacggtctatttatagcggttaatacaggaacatcatctaagtccaccttaggacttgttatcggaaaaatcagttctggtttccgtccatacattcgctcgaacccatcacaatcacgtttattaagtgctattaaagaggtagcatatctcacagttcgcttttcattgaattttataaagcgatattttacgtaagagacaagagaatgatcatacaagtattcttgataagccattgacgcatctacattatgctcaaatatcacggactttgcttctaatccatgcaacaatttaacaatcctaccaaataatgacccttcaaagaaaacgaaatcaaaagaatccttacaatagacatccattatagtttcttcgtctcttttagaaacaccataacaccccatgcgtaataaagataaaacgatgattttcagagtagggcgagctactgaataacaaatgacattatctcctccaaataagcgagtaagcatctcataatttcgatgcatcacataagttccaccgttaaggactgaggaaaattctcgatggacatataatattctcatgattcaagatattaaataatttgagacagaaataaacttaagatcgaattaattcttttgtactatccaaggaagaaattcgcagcaataaaaaagacaacaatagataatccttactactataaaacacgaataacatcattataaatgtaaaaaatgacattacttgtctggaaagaaataattttattaataaatggatatacataatcaaaataataataccaccacgcacaaaaacaccatagatcgccaagtgtaatcttacataatcattgcgtatcatatccaattctttatatcctccatatcccgcaaaaggctgaaaccaaccaaacaaatccggaactcctgctcctgcccccttacctataataaaataaataggattaagaataaagtaatataacaaagttactaactctgcgacaagattaccaatactactaaagtctgatgcaacatccaatatactaattgaattaaaaagcaataatacttgatgaaacttataagcaattgttccattctctagattctcactcagaaattctaataaaaacaaaaaccatggaataaataacagtattaacaaaatattaacccaaaaaatctttttattatatccaagaatccagagaagtaaaagcccaaaacttataatcgtttttcctgaaacaaaataggaattggttaacagcaaaaatattattatcacaacagaagataagaaaaaaaatgaggtataatattttctcattataaaaaccccacatggtaataaataatacaggctattatatacaacaaactcacttccaccatattccattttacgatgtagaagaaaagcaaatagtaatgaaataacactaatagaaaaagtatatatcaatacttttttcaagctttcgacatctaaatttttaaatagaacaaagtagaatagaacaggtaaaatagccagcaaatcatctatatagttatccgaataaatatttccaaaaaggacattaacaaaacctacgacagctatccatatcaaatatataagtaaaaacctagaataaggatccatgcagtagctaatagataatctccgttttaatattaaaatcacacaaaaaaagaactgaattacaatattcaacgaaacccccccaaatcgtattccccaataattcaaggaagaattgtctaaatgataataattaccccatcctatagtcaacaaattaaaagagataagatataatatagcattttttttatttataaaaaataatattaccaaataggcataaacaaggcaggaaaataaaaacttaattaaatctatcccttctattccatataaaaaaacatcgatcaaggaaaatagaagtaaaatacagaaattataattgtccatagagagcctttttccacaacttgtagatatcaacttaaacatcatgtttattcaatagaaatttataatcaggcattaacgccaacagatcattaacactctgcgatacttcagatgacgacaaagacaaaagcgtttgcagcgaagaaagcacatcactattagatgtaaaatatcgaatatcaattcctacattttgatattgacgaaaataagaagtatcacttaccaatgcttttttatgattagaaagtgcctcaagtaacaccccactagttctatactgaaaagaccgaggataaggtaaaaaaatcacatcactttttagaaataaacactcataatcctctttctccatcacatcacgtatgatatgaatatatccacaggttgatttcaagacttgtgaacgtagaacaaaaagaacattattactagccaaataatcaagaaaagcggaatctgcgataagaaaggctagtacatgttcatcaacgctggtcaaggaaggagaaaatataattttactataacccttaaacttttgatcgtacacagaagtagcacttttattataaaatggtttaactaaaccatgtgcaacgacttccacattgtcaacacctaacgaatgtaaataaacctttgactctgcatcaaggacaatctgcttataacgctttgacacacatctgtaaaaaaaacgttttatcctactaaatggtaatccacttacatttatatgattaattaaatatgtaaacaatggatatttaacaaaaaaaagacatatttcatcataataggaaaataggataacatcataatcattcagttttatatttcgctttatcaaatagtacacatatatggttatcagcctacttaataaagaattttttgtccttttgtaatacctcaaaggtatgctataaacaatattatcagatgcaatatttaagtctttttcatatccttctttaaaaacaaaatcaactctatctgctatcttacaaagagcctctatttgcattctattataattagaatgagccaaaaatgatgcaggatctatataaagtactctcatattaatttaccatcttagcaagtatagacattgatttatttctctctgtactcaaaatagcatttacaggcgtataatctatatcatttatggcagtttcaccattatacattcttctcgaaagattaaatttattcaatatagagacacttcgactggaatacttatcaggtaaaaccgctaaaaattgcttattaaaattaatagaaaaagctgttccatgaaaagaacttacaatcacgtagtcagccttactaaatagagaaataaacaaatcaggcgttccaaatacaaaacgcttatcacattttacacttttaacattccaactggtagaatacacatatatcttcaagcctctcaacgatgctatatctttagccaatttcataattagatcatcattgttccattcgaccgaatacaccaataaaaaaggctctacttttataaatgaagatttcttgaacacagaaagccattcctctttggataaaaggagcgtaggatctagaacttgagtagagtcataccctaattcggtcaactgagctttagctaaatcttcccttacagtcaaacaagcatagcatttcaaagcactacgcatagattctttttctatatcagacaaactattttgtccgatacttgccgcataagcaattttttttgcgtgttgaggagcaaaatctaaataaaatactggatctatccccctattgtactcattattccatacttgatcacttcctgtcatataaatagtatttctatcatctattttagataaggtgtttaaactacacatcggaattaccttacggactatgtgcttcaacctcattcttaaaatttgctccaaactaatattaataatagaaagcccttttcgaaaaaatgatttcgactgattcctaaaaacattctttaccaggtatacaaatcttaaatgaggacggctataattaacaagtacaggattatgtcccaattttcttacacatacacctaacgccaatgcttgcaaaaaagtacccgtatttatattatcaagaattgtagctataactatctttgccatactacttatttatatattagcattttcaatttattaaaagctgatctaagatgaaaaacatcaatccatttagaaacataatttctaacggaaaaaggcttatgaaacactttgtattttcttaaaaagtcatccaaatgcatattatcaaaatcctcataaaacgtatccctaagatttggacgtctgctagctctaaatatattaggattagccaatttagcctctttcaaacttcgagcctcacaatatgcctctttttgtatatcttgccataattctatccctttagaattattgattaaaatacatgatactccatgagttgtatcatggccaaacaacttccacctacctataccccaaaaatctccaattgaaatatctccttgcctaggtaaagccgcaaatggacaccgatagcaagattctctaaagtttaatccttttaaaaaggattgaagatatatatcatccgggctattatatttaacaacatgattaccatagctttgttgacacttccatgtttttgtatccctaaagatgagagatttcgtcacatcatatcccctatcgctcagtatacttgatgttttatgtaaaaataaaggcgagggaaccccatgacaaaatatatctactaaaaacagattagggtatggtttccttaaaaaacgtttaaggcctgctatttgacatggggtaccggtaaacaagactaaacgacctttctgtaagatctctcgtacctcacgatatgaataaccaagggtactttgaacatattttgatcctcgcaatttatctaactcatctatagacgtgatactagtatgatatacttcgttattagaattaatagccgcaccaaaaacaacaccacctctatttataaacagcatagccaataaagagaaagcacctccagaagaactgcgttgacaaatagaatcctcagcacataaagcatatgtagaaggagctggatcattatcatacagtttatcctcattcaagacaggacatgctttttcacacaaactacactctttacatttatccacatctatcacaggatacaaaaatccttctttatccggttgcatagacagcgcctggtgaacgcaaacattatagcaagagctacaacctgtacaatcttttttatcacacagttttatcataaacttttatttttttaatctttctaaagtaagagccaccattctacgttcactcctatctaagcctataaagtaaaagagtactcctacgcttaacaaagatgagataatggaactaacaatcttaataattggaaatgaaatatttaaagaagaaaaacaaacaagctcataagaaatggctgtcacaataatacttctaaaaacaacttttcgcaaataagaatttgtaggaaaactaaatagatatttcaaatataatagccttactatatatatcaaaacattcattaccacctttatgcccaacgccacctcaggaacataacctagtctaaaaaacaaatagcttatgggtacgtttgataagatcattatgcccatcaggatttgataattgcggatatttccagtagcctgtacagagatccaaagcggtccctgaatggcatctaatagagagaagagaatcatccaccgacaaaaggagactgtatatgtaggcacctcacctagccacaaggccaacacctcctcacagcagagatataaaggcagtgagattacataaagcaaataataagaatacttggaagttcgcatgatcaagtcgatgaaatagcctcgatcgcccgaggcgtaagacttaacaatttgcggattaaaagccgtctggaaatttccaacgaagctataaaccgccgattgtacttgattagcaatgcccatagcggcatttaccgtcacaccaaaaaagagattcagtaagatattcaatccctgcgaagctcccatattggccactcccccgaacaggctccaaccggagaaccccaacaacgaacgatacaagcctttgtcccaaaagaaccgataaaggcatacggcaaacgaccgcctacaatacaaataatagcaaaccgttatcaaaaccagcacgacaaacatcaagaacgcataaaagatcaaacgatcccaagatgccaaagctagcaaatagacaatcaaaaggcgaagcacggcctcaatcacgctactataagcataaaacgacatccgctcatgagcgatgatggcagcgttataaggggtacgaacgacattgatgcaggtggataatatcgtaaactgatacgttagtgtcaccgcccattccctgtccgaaggatactggatataatgctccaaaaaccacaatcccacggtctccgccagtacgaacgtcaacaacgctatacccagatggatcgtgacactagctgagaacactcgccgtaccgcctccgaatctccatgccccaactcataattcaagaaccgttgcgtggaggtgaccatggcgttattgacaaatgtgaagagtaccactattccccccaccacattataaatcccgaaatcctctacccccaatacttgtagcacgacccggctggtgtacagcgtcacccccatgattaggagcattcgcatgtagaggaatagcgtgtttttcgctatccgcttattattctctgacgtagctgacataaaaatgagcacataagacacgcttaccccgccgatacaccagcgggacaaacacatcgaatatttagatttaaaatgagctcaagcgatatttatagagatagatcactgggacaaatcattcagcataatacaaatagcagagtttctaggatctctcatttatctcatcccttcccccagcacatacttcctgatcccatatcgaatgctcggtacattcgccccgttcacgaacgtgaggtgaggcaagagggcgctgatgaaggcacggctcttgaccagcttgaggggagacgagtagtcggctaggatctcgttgtaaaggtctgtcaataccgtctggcaaagggtgaccgtgtccgggcaggcgcataggcgggcctcgtagacaagacgggtcgcctcgtccgggatgaacaaggccaacgaggagggttcagccgtcactggaggggcaggagagtttatcggaggagacggagactcatgaagtcccgattccgcgggcgtaatccaacgttccgtccgtgtcaccgtcccgtcaccccaatggatgttctggatagcgatggtggcattgggcaggatctgcacgttacctccattgaccgtaaaggcagaacgtgcctgttccgcccgctcttgattttctgtcatatccgtttttaatttaagtgttaacaataatcacccttttcacgggggatatttatttctatcctcatttcatccaccatacgtccgtttccgtacccgtcccgtccatcgctattccgggaacgggcaggaacgcgttcctttaccggcagtaaccgaataatcaatttattttatccgatcatgaaagagtctatcttttcctttttcaacgcccccatcaccaatcaagtaccgaacggggtcgtctgtgtcagtcaattgtacgcctatatcaccaccagcgagtggctgcgtgagcgtaccgatcaggtacgtgccgcatcgagcgacgagaaacggttcaggcggctgaaacagagtttgctaccctatgtcacgcccgccggtatcttctcctaccgcaaggaagatcacttgctcgtgccctcgggcgagttcgtcatcgacatcgatcacctctcctcacccgaagaggcgatctgttggagggacacgctcttcgccgatgagcggctacgccccgatctctccttcgtgagtcccagtaccacgggaatcaagctcctcgtaccctatcgcctgtcgatcaagaaaaccgtagaggagtctttcgacgaggcggtacgattcgcttgggaataccttgagtggaaatacgggctgaaagctgatgccacgaacgcagacctctcacgggcttgcttcctttgccacgatccctcagcgaggctaggagaccggaattgttgacagaggacaagtgacagttggtagttataaatcattattcaccattcattattcattcatcatgaacccattatcagatctggagcggctcgttgccgccatcgagaaacagggggcgaacatcgctcccacctatcaagagtatatgccgatcgccttcgccatcgccaacgattgcggagaggccggccggacattctttcatcgtatctgccggatgtcggagaaatatgtctctaccgaggcggataagctatacgaccatgccctcaaaggaggcaatggacggaatggcttgggatccgtattccacttggcggacctagccggcgtgaaactggacaaatccatggccgaggccgggaaactttcaaactttcaaacattcacgcctccttcacacacgcacacgtgtacgcacgaggaacagtccgtgaaaaatgtcccgcccgcctttccggagtatccttggcccgctttcctcaaacggatgatcgaccggggcgatacccccgcccaaaaggatatcctcctgctgggaggtatcaccgtgttgggagcgacactcaacaaatcgatccggatatcgtacgggcgaaaattctactacccttgcctgcaaacgttcatcgtcgcccctcccgcctcgggaaagggagccctcgcttggacacgccggcttgccgagccgatacatgaggcgatgatggcgaactaccggcagaggcataaagcttaccgggaggagaagagccgttgggactcgctgggcaagaaaaaatccgatacgccggagcccgagatgcctcccctcaagatgttccttatcgccggtaacaattccggcaccggcgtgctggagaacctcatcgaggccgacggcatagggctgatctgcgagaccgaggccgataccgtgagcacggccatcggcaccgagcacgggcactggagcgataccttgcgtaaatgccacgaccacgagcgactggctttcaaccgacgcacgaaccgggaataccgggagtgcccggcctcttacctcagtgtcttgttaagcgggaccccggcgcaggtacggccactcattccctcggccgagaacgggttgttctcacgccaattgttctaccggatgccacccatcgacgagtgggcggatcagttcgagcagggcgacgaggacatggatagcctcttctccgattgggggaagcagtggaaaatgctcgtggactacctgcgtgagagggtcaatatcatacaattccatctctccgacacgcaaaaggagcgattcaacagctgcttcgcacgcatattcgggcacgccggcctttcctacggatatccgatgcgaagctccgtggcccggatcgctatcaatatctgccggatcgcttccgtggtggccttcctacgatcggtggagaatctcctcatcccacaagccattctcgattctcagttttcaatcctcaattgtcccggcctctcgcctgcccccgagatcccggaggagaacgtacgagacggtatcgttccttccctagagttacgtatcgatgatgacgattttaaggctgtcctctcgctcgtggagccgctctaccgtcattcggcgggcatactcaccctgcttccgtctgacgaggtgccacgctctcgcacgcccacgccccaagaggctctcttcgcggcccttccactctctttcaaccgacaacaggccttggaggaagcagagaggaacaacatccccaccgccaccctagatacctgtctcaagcgaatgcaggaacgaggcacgctggagaagaacggccggggcgagtacagcttcggcggccgtgtcacccataagtaatcccggcctccctcacacccctatataacgtaccccacgggcgtgtgtgtgtgagggggggacgaatgtttgaaagtttgaaagtttcattctcccaaatctataaatcataaatcaaatgttcttgccattaagaaagtccgcactagcggcatcctatttcccggagctggcctcccatcaagcttgcaaccgcttacgtcgttggatcattcgatgcacggaattgcacgacaagctgctggagacgggctaccgccccgagcaacgtatattcacgccccgacagatcagattaatcatccactacctaggagaaccgtaaattagttgacagttgcgcacagaggtaaataaaaacagcctactgtcactagtcaactgtcaacttggatgggtattctaagatctttacaatgcccatccaaggcttcttataatgcctattcaaaggggcttacgataggcagcgtaagaaaccggcggttatcactgcgtcccatgttaattaatcgttattccctaccccgggcatcaatcggcatcaccgtcccttacggcggaacctatctttgtaacattgatcagcaagcaattaattttctattattaatctttaattatcaaactatgccacaagcatttcaagcacgaaagttttttatccccaagacggatcctaagcaggaggtgtacaagccggttccctattatttcggtaccctgtccacacaagatgcggccgaccagatcgccgaggagtcttcgctcacgaagggtgacgtattgaacgtattggatcgttatcagcggtatgtcatcaagaacctacagaaaggttacaaggtggagctgctagggttcggaaccgtctataaccgcttcgtcacggagaagggggtagcgaccgcccccgaggtcaaggctacgcatatacggactatcgtgccgggattctcgccttcctataccatactgaacggggcacgacgctactcgctgctgggcgagaagacttcgttgctcaaggtgacgatactcgggacgccggtagaggaagggggcggttccgattctgagtcgcctgatgagatctgatgtgtcacttttggcttgacccaaaagtaaccaaaaggtcaaggctgacgctgacgggctacttcgagacctacgctcgctgtcgcatcccaactcgcttcgctcagacagggatgctccgggcgctcgctgcggtctcttcgcttgacgcccgtccgctgaggccgtccaaaggaaagccaagctttcctcttatatcagccgggattcctaattcataattcataattcataatttaaaattcataattcatgaaaaagtccgtatggagtaccattatcaaagtaatcatcgccgtagctaccgccatcgcgggagcacttggcatccaatcctgtattctctaattttcaatttcaattatcatgggtaaggtttattgtttctaccagaattacagggaggtcagcctccttgtaattcattgctcggccacacgatatgacagggattttcctatggaggcgctccgttcatcgcacaaggcacggggattcgccgatatcggctatcatttctatatcacacgggacggggaattacaccgctgccggccggtcaaccagatcggggcgcacgcagccggatggaacgacaaaagtatcggtatatgttacgagggaggactcgacgaacaaggccgtccagctgatacccggacctacgcccagcggtgtaccttgatggatctgctacggcaattacgaagggactatccggaggcacgcatcctaggacattaccaattaagcccttacatacgcaaggcttgcccttgctttgacgcaagggaggagtatctcgtcttataaaatagataccggctcgtcattcactcgctagattgtccggtttcacgacttactttgtaaaaataccccctatctctttcagctcttgctctttatgatgcctcgttatgaagcggttgatcgtcaagtgaaggatagaccataaaaccaagttcaagagcaagaggtaggtggcgtttaccttcatggccaataagacattcaatacgatgaaaaaaacagatacgcacagaatcgtcaccatcaccatccgtacacgcatacccgtacgaagcaacttgtgatggaaatgattcttatcgggcaagaacgggttacgatgattacgaaggcgatgaagcaccacacggatcacatcgagtaaagggaccaagaccgtggagaaagcgatcaccatatagggatttggtaactccggtaagacttgattcgacacgcacagatggatgatcagaaaactgatcacgtagcccagcgtaagactacccgcatcgcccatgaaaagcttatggccacggtttgcgttgccaaagacgttgtaacaccaaaaaggcatgaggactcccagcgtacagatggccaacaaggcgtaaacatattgcatgcggataaagaagatcacgctcaagaccgacagggcgatgctacacaaaccggaggccaagccatcgataccgtctatcaagttaatagcgttcgtgatatacaccacgataaagaccgtgacagggatccccacccaagcgggaaccgagtacacaccgaacaagcctcccaaggaaccgaaccaattaccggacagtaccaataataacgccgacacgatctggacggcgaacttgtaacggtagccaacacccactagatcgtcgcagacacccactagatagagtaacgtcatgcccacgaacagaaagagatactcatagagcatgttgaacgacaggctcgatgagcccatatcccaaaagtacaggcggaagcctatcacaaggaacatggacatcaggatcaccggaaaaaacgacaggccgcccaaacgggggaccggcgtcgtatgtaccttacgggaatccgggacatcatataaccgtttcttgtgggagatcaccaagatcctcgggatgatcaccatcccgaacagcacggagaaaaggaagcccgacagtagtagtaatgttatttgcatgatttgcgtattagttatttcttcttgtcaccggcctcgaaaccgtaaccatagccgtagccataaccgtatcccttgccgtagccgtatttcttgccgtaaccgtagccgtagctgttcttgcgcttcgtcatgtccaagccgttgatcaccgtcgcgagcttcgggaactttcgctcacgccgcaacacgttgatgtagctgaaaccggccttcggtgtcacgtccgcacggcagacgtacacgcacatgtcggccacacggccgatgatcgccgtgtccgtaaccatgccgataggggctgtatccaagatgacatagtcgtagcgttccttcaaccgggcgatagccttctccagcacgtcacgggcgaccagctcagtcgggttcggggggataggaccgcccgggaggatatcgaggttagggctgatatcggatcgctggaccatgtcgaacaactccacgtgatcagggtcgctaaggtagttcgtgatgccctccatcttacgggagatattgaacaccttgttcaggcccggcttgcggatgtccatgccgaccaccaccaccctcttgcccaagtaagccaagctcaccgccaagttgccagcgacgaaagacttgccctcgcccggttgcgtggagctgaaaaggatcacacgctcgtccttgcctagcatgaacaagaggttcgtgcgcaacccccggaacatctcctccatcaggtcgttcttgttctcacgcaccacgatcgagccctcacccgtcttcttgaccaacgggagctccgccaagatagccacgcccgtgatcgcctcgacgtcctcacggttctcgatcttgtatttcaacaggtcatgaaggtagacaatgcccaccgggatcgccaggcccaagatcaacgccgcaagcatgaagaccatcctcttcggggcgacaggacgctcatcggcgagcggctcctcgatgatgcggccgttgtttgccgtggctgccagcgtgatggcgttctcctcacgcttctgcaacagcatgacgtacaacgtggccttgatctcctgctggcgggagatcgtcatgaactccttctcctgcctcggggcgtcgctgatgcggctctcgaacttgctcgcctgacggtcgatgtccgccttggcgatctggagacccctcaagacactgttcaccgtcgtcctcacgttgcggcgcatagcctcgatgccggcgttcatgttgatgatggccgggttgctgtccgaagaggtgcgcaacaggcgcttgcgctcgatgatcatcgtgttgtactggtcgatgacagaggtgaggttttgatcccgcaggcccacgttggcagggatcacctcgtccatgttcgcaggatcgtcgatataattgcggagatactgcaccaagttgatctgcgtggcgttctccgtacgttgttgctcatacctcgagctttcctgcaaagccatctgggcgtcgctcgtcaaattcgtcaggccggagcgttgcttgaaggcagcgagctcgctctccgtagtgcccagctcgccgttgatgatgccgatgcgctcctcgatgaactcagccgtcttctgcgccacctcgttcttctcgtcgttggcgtcctggttgtagaacgacaccaagcgattgatgaaatcaacgcctcgtcgcctcaccgtgttcctcaaggataccttggcgatcgtcgtcgtcttggacgagggcgtcacgctcaactccttgccgtaagcctcggcagtggacgtgggcgtatggacgtgggccaccagctcgatctccccgccctccaactccggtatggaatccatgcccgtgaaactgaaaacccctacgggggtgggcaatatggcggggagcctgtcgaagccctgctccatcgtctcctcgtcaccctccttgtcaatcttgtactccgctctcaccgttagctgaccctccttcgtgtagcgcatgcgtagctcgacgggggccaccagacggtccgcctcctcgggggtgatgaacacgttaacgggggagttcttgtataaaggggggttaaagcccaaggcgttcgactcctccatgtcgatatacaggcccatgtcactcaccaccttcttgatcaacgtgcgggacctcaggatctcgacctcgttgtcgaagttgctcgtcatcgagagcatgccaaggtcctgtatcgcagccaagccgctggcggcgtttgcccccttcttctcgtcctccttgatcagcaccgacgacgtgacgttatacaccggcgtctggtaacgcaggaagacgtacatcccgatgcagcaggccagcacgctcgccacgaaccaaggccaataaaccatatacttgaaaaacacggcgtaaagattgatctcacgatcctccccctccggattgttattgttattattattattgcttgtatttataccatcgtccaccatctctctaaattttcaattctcaattctctattttcaattatttaagtatgttcaccaacaggccggcgatcgagaccaagatcgagatcgagctcacccacaacgtcgtgctgttaccgatatcggagttcttcgccttcgtctcgttcggcgtgacataaaggatgtcgttctgtttcaaataataatacggggaggtcacgattccggcgttgttcaggtcaaggttgatgatcttgcgcttcccgctctcgtcctcgcggatcagcttcacgttgtcacgtacgccgtagatcgtcatgtcgccggccatcgccaacgcctccagaacgttcaccttctcgttgccgatcgtgaagctgcccggacgggccacctcgcccaagaccgagatcttgtagttcgccatgcgcaccgtcacgatgggcgcctccttcaagtaaggcctcaatctctcacggatcaggctctccgcctcgttcttcgtcaagccgccgaccctcagcgtaccgatcacagggaagtcgatctcgccggagttgttcacgaggtattgctgcaacgtgggttgcgtcgtcgtgttgatgttcgtcagggccgcgttcaacggggtctgcaccgtcaggttgaacggggccgccgcctgagggtccgtcgtgttgaccgtgatgctcaacaggtccttcggcatgatcttggcatcgtacaacgggagaatctccccgaaatcgttcaccacctccgggttctggaggtagggcacgttcttgtaggacgtgcacgccgccagcaaaaggggcagcgagaataggaacagtagtcttttgatcttcatgttatcttgttatcatttttatttccttgaacacggatgacacggacttaacggaaaaggcgggacaggaaacctttgggtttctccggctcgtattccgactcgtatttatgtgtcaagtcctcatagctcagtcccttggtcaccatctcgtagatcgtgccccagtccgggaggccgccgaggttgcggtcgtcgatgaaaacgtccgccttcagcttgcgggagaagtggttgttccggtctctctcctcctccgggtagtcacggttcaccgcgtagaactccaagccacgctcacggcagaaggacagcgcctcctccaagagcccgccctcacggaccgtccaaaggatcagcttatgccgatccgattgcaatttcctcaacgtctcgatggcgaaaggaagctcacgcccgatcgccggatacttgtgctcgacgatcgtaccgtcgaaatctaccgctattatcatctctttaattctcaattttcaattctcaattataaaagggccggaccaccggacggccggagtggtatatgttaaagcggggtcagcctatcggccaaagccaaggggtctcctagccgctagagacggccattgccatccgggggatccgaccgtttcttttctgcccttatctaattctcgcttaaccggggcaatccctccacctcgccggcgtgccattcacggtagtccgccaagggaaacccggggacggtcaatagcttgtaatccgacccgtctcttctcaagatatgcttgcgagtatatgagcggagcgagcgatccgtaacggacaccatcacgatcgggaacgggtaggcgaacaggcgcaacggagtggtctcgctatccgggaacgcacgatgctgctggtaggccgaacgctcgaacgctacccagtagggacccgtgcaatacaggtgtattgagtttcggttcgcacgctcacgatccatgatctctgtcaaacgctcacgcaacaggttcatcagccggatgcccgaaggaacgccgcatgtctctctctcttctctcatatcttttattcatcgccgttcccgtgcccgaaccagcggtcgtaatcccgtaaacgacgtatcaacacggacttgctcctcttgggcgaggcctcctccatccaagggccaaccagctcgtgcgccatgcgctggtagaggctgctatccgtacagccgtacagcgtgaccagcaacaaggcacgggattgccccgcttttatcaccgggagcatgctgcgcatcgtggcatgcaaacgatcgaactcatccgactcgcccaaaagcagataggcaggaaggagcaaagagtaaagcttgcaacggatcacgtcggtctcaccacggagagaggcgtagccacgcaggacctcacgggccagacgggcatcctcatccactaccacgccagaggcgtggtaacggcccaaggccccgtgcaagccctccgacagacggtcgttgtccaaatgggtatacacgtgcttgccccccgtgttcagctcgatcaactcgtactcccccgctctcacctcgaacaaggggacccacagacagtcgaggatacgcaccatcacgtccttatgcccaccgcccggctgcaccaccacctccgcctccatattggaaaaagggccggaggtgatacgcacacggtcgcctttcaacaagcggccgctatctggcacgtacaccggaagctcgttggagtaagaagccgcgacccaacgcaaggtatccatctcacgatccgagaggtacgggaaataggaccgcccgccggaggaaacccgggggaggaaattatacaggggaagcgtacgcttcaggcggaagatctcgtcctccgaggcgtggacgaacacgtagttgtacaacaggggttgcctcgtgttgaccatcttgccgcccaccttcctcgcctcgacatacgagggggagaaatactcgaacaaggcctcaccacgacgctcacggcgggaaagctcagcgtccagccccttcgagggactgatcctgtcacgcccgccaccggcggtagggagcgtgagcacgtaccagcggacggcctcctggtcacgtcgcttcagaacatgcgccatgaacctatccgagcacttgcctgtcaatatatccatctctatgattatcttttccagtggttatcccgtggcccgaaaacagaccccacggcaattcagagccctaccaagaatcttttatattatcttgataaacagtactttatatttttaaatgtggcattactgaaaattaccgtctcttgaaatcttaggctacttggggagtagcgtattctttcacggcgcaaatgtagtaaaaaataactaaaaacaagcaaacaaatgcgcttgtttactcattgtaggcgtttgatcctctctattttttgattttcctgttttatcctagacgtatagacatggtgatgcgggtgaaatgacctcttgttcccggtatcattccaccatgccttataacctgtgtgtattcctgtagagacggggcatgccccgtctcatcccctccaaatggtaacttaaagatactatcagacagtgggagacggggcacgccccgtctctacaaccgggtgataaccgttctcgcaccttttaggctactccccaagtagcctactccctttaccctactttcggtacatgattgtacacactctcaaaacaaattttattcaccgcagacatcttttccaacgagaaacttttcaaatagatttgcgtagtcttgatcgatttatggcccaatagttcgctgatcatctcaatcgggacatcctgttccttcaaaatcatcgcaaaagaatgacggatcgaatatgaggtgatcgggatagacacaccgcaggctctcgccaacctcttcaaattccggttaaaatgggccaaagcggaagtgtactccttgtaggcttcttttcccacttttatccctttcaagaaaggaaacaaatagggtgagtccttacctacatcacttgacagttccctcagcgactcccatgcggtagattgtacctctataagcatcggagtacccgttttctggcgtttatattccaaaaccccaccccggacattctcctttttcagatgagcgaaatccacgaatgccataccgcaaaactggaacatcaggcacaatgcctgccgtgtttttctcagttccggatcatctaatgaggccgtcatcagagaacgtaataaatcctgtggtaacgcctttttgcgtttgctctctatacccgtgaaaactcccttaaataaataagggatatagggggccaacccttcctccaccgccatgttgtacacacaacggatccgacgcatataggtcgacaccgtgttccatgtacatcctttattcaacaaaaaggcctgataacgccgaaggttctccttattgacataaatatagggaattacctccaacccacaaaaccgcatgaatgagttcaatgcatcctgatagctcttcgccgtggaataacgcccatccacacgcaatttatagatatacaacctcatcccttctactaaatcctttttctccatactatcgctattttttcgtgataaaacttagcaaatgtaatacagatccgggaggttgagcatatacaaaaaaaggcgaaccaaccggtccgcctttataaaatctccatttctagattatttcagtcctctattcttcagcaacggatccgtacccggttccttgccacggaaattcttgtacatatccatagcgtcgtcgataccgcccggggtcaagacatatttacggaatttatcggcacattcttgattgaagatatcgccggtttccttgaatgcctcgaaagcgtcgcaatccaatacctcggcccagatgtagctataatagccggcggtgtagccaccacccatcgtatggttgaagtaagtcgtgcggtagcgggaagggatttgtttcagcaaaccacgacggcctaacgtctgttgctcgaaatccatcacattcaagttggccggaacattattcgtctggtcaacgaacttgatcactttcttatccgcagcgtcaccgctgatcgcatggaaatccatatccagataagaagccgccagatactccgtcgtagcgaagccctgtccgtacttaccgctcttatccaacttctcgatcaactcggccgggatcacctcgccggtctgataatgcttagcgtacaccttcaatacttccggctcgaatacccaatgctccataacctgtgaaggcaactccacgaaatcacgaggaacaccagaaacaccggagtaatgcacgtcacggaacaagccgtgcaaaccatgaccgaactcatggaacaatgtattcgcctcatcagcgctcaacaacgcaggttgtcccggagcgggctggctaaagttacaaacgatcgttacgaccggagccacacgcttgccatccttataagcctgcggacgataagaaccgcaccatgcgccaccacgcttgctggcacgagggaagaaatcgaaataaataacacctaaatgagagccatccttatctttgcactcaaaaacctgcgcttccggataaggcaacgggatattacggatcggggtgaacgtgataccatataacttattagcaacatagaaagcaccctcacgcacattatccaacttcaagtaaggacgaacctcgttctcatccaaattgaatttagctttcttggccttctcgaaataataacgccaatcccagccctcggcctcgaaattgccgccttctttcttgatctcggcgttgatatcggccaattcctctttcgctttcgccaaagcaggcttccaaacctcatctaacaattgataaaccttatccgagcttttcgccatacgatcctccaacacgaaagaagcgtaatcatcatagcccatcaacttcgctttcgccaaacgagcggcaaccaaatcacgaaccacttccttgttatcgttctcattattattattaccacggttgatataagcgttgaacatcttctcacgcaactcacgtttatcggaatattgcaagaacggcatcacgctcgggttctgcaaggtaaatacccatttgccttccatcccggcatccttagccgcttgagcggcgttagcgatcaaggtctcgggcagaccggaaagatcctcctgcttgtcgatcaccaatttgaaagcgttcgtctctttcagcatattctgtccgaaagtaagctgtaacatggagatcttgctattcaactcacgcaatttagcctgatcctcagcggaaagattagcgccaccccgaacgaagtccttataagtctcctccaacaacttcatttgctccttatcgagacccaactcatcctttttatcgtataccgccttcacacgagcgaataatttcggattcaagttgatatcatcactatattttgacaatagcggcgacatctcacggcttaacgcctgcatctcatcattcgtattcacgctattctgtccaccgaaaacgatctggaccttccgaagcaacgcaccctgctcatccaaagcgacaatcgtattctcgaacgtcggctcctccgggttattcacgatcgcctcgatctccttgcgcccctcttccatgccttgcaatagggccggtttgtagtgctcgaacttgatttgatcaaaaggtggaactccaaacggggtggtatattccgcaaagaacgggtttcccccctccacggtcttcttttcggaagtaccgcaggcagtaagcataacggctaatcctgctgccataattaattgtttcatctttactgattttttgatttatgagttataaattgttctgctcattttagccctctgttctccaacagcggatcgatgctaggttgtttgccacggaaattcacgtacatgtccatagcgtcatcgatgccgcccggggtcagtacgtatttacggaatttagaggcaacctccgggttaaagatatcacccgtctccttataagcttggaaagcgtcgcaatccaacacttccgcccagatatagctataataaccggcggtatatccaccttccatcgtatgtccgaaataagtagagcggtagcgagacggaatctgacggatcagaccacgatcgcccaagaccttcgcctcaaatttctcgatatccaaatcggcagggatctctttcaatacatgataatccatatccagataagaggcggccagatactccgtcgtagcgaagccttgtccatacttgccactcttaatcatcttgtctacaagggcttgcggtattacctcgccggtctggtaatgtttagcgtacactttcaatacctccggctcaacggcccaatgctcatcgacttgcgaaggtagctccacaaagtcacgaggcacgtcggacacgccataataatgaacgtcgcagaataaaccgtgcaaggcatgaccgaactcatggaatacggtctcggtctcgtcggccgtcaaaagcgccggttgtccctccgccggtttgctgaaattaaatacggtagtaaccaccggggctacccgtttcccatccttatacgtttgtgaacggtaaccgccgcaccatgcgccacctcctttgcccgggcgggtaaagaaatccatatacaatacgcccagatgcgtaccatctttatccttgcactcgaaagcgagagcgtcggggtccggtttcgggatgtccttgatctcggtaaacgtgataccgtataatttattggctacatagaagatgccctcacgtacatgtcccaactcaaaataaggacgcatctcgttctcgtccaagttatatttcgctttcttggctttctcgaaataataacgccagtcccagccctcggcctcgtaattaccgccttccttcttgatctcggcgttgatatcggccaattcctctttcgctttcgccaaggcagatggccagattttatcaagcaagtcgtacacgttcttctcgttcttcgccatattctcttccaatacgaaagcggcataatcctcatatcccatcaatcgggctttctccagacgagcggcaaccagctgcttaacgacctccttattatcattctcattattattgttgccacgattcgtatacgccttgaagatcttctcacgcaaatcacgcttatcggcgtattgaaggaaaggcatcacgctcggattatggagggtaaacacccacttaccatccagaccattctcttgggccgtttgcgccgccttgacgatcacgtcttccggcagaccggataagtcctctttattatcgatcactaattggaaatcgttggtctctttcagggtattctgtccgaaagtaagttggagcatggatatcttctcgttcagctcacgcaacttcgcctgcttatcctccggcagattggctcctccccggacaaaacttttataggtttcctccaacagcttcttctgttccttatccagatggaagctcgcctgattctcatatacggatttcacccgggcgaaaagcttgggatttaagctgatatcatccgaatgtttggataaaaggggataaagctcacgttcgagctcttggatctcgtccgtggtattcacactggattggccaccgaaagcatacattactttagtaagcaactcgccactttggtctaaggccacgatcgtattctcgaatgtcggcgcatccggatttgccacgatcgcctcgatctccttcgactgctcttccatgcctttcaaaagagccggcttgtaatgagccacctctatttggtcaaacggaggcaccccgaacggtgtcgtatactccgcaaaaaacggattgggtgtagcgccttccgctacatcgcttttctttgaggaggaacaagctcccaaaataaccgctaaacctgcggccataagcgttttattcatgccattgttatattagaattacaatggacaaagataacgaagttttgcgttacaattctatttcaaattgttattatttagaatccggaaaaagattttcacaattcacacaaaaaagatccccaaagggagatcttcccttcggggacccaatatgcattcattcaatgttcaatcgaatcgctctctataccgtcctcgatattttcattttcgatcgtttcttgtaaatcttgaatgtcattagacgtgtaatcatccgacaataccgaattggtagacatggtctcatcgtgaagatcatcgctctcatcccataacgttttcattatattctctggcatatctcttatattttaaagttatatgcctattcaacaacctcgacaaagaaattgttgttccaataaaaatagttcactaattttagcgagattaacgcaagaaataatatgaatcgaatttgtagtctttttggtattcagtatcccatcatacaggcgggaatggtttggtgtagtggttggcggctagcttcagcggttagtaacgccggtggattaggattgatcggggcaggctccatgcacccggaagtgctccgggaacatatccgtaaatgcgaggcggcgaccgacaagccttttggcgtgaatgtcccgctaatgtacccggaaatcgataccttgatgcggatattggtggaggaaaaagtgaagatcgtatttacttccgccggtaacccgaaaacatggacaaagtatttgagggatcatggcatgacggtcgttcacgtggtaagcagctctaaattcgccacgaaatgcgaggaggccggagtggatgccatcgttgccgaaggcttcgaggccggcgggcacaacggacgggaggaaacaactacgatgtgcctgatccccgctgtccggaaagcgacctctctcccccttttggcggcaggaggtatcggaaacggtcaagcgatgctagcggcactcgcactaggggccgacggcgtacagataggcactcgtttcgccttgaccaaagaaagctcggcacacgagaatttcaagaaactatgcttgaatcttaaggaaggcgatacgaagttattattaaagaaactgtctcctacccgtctggtaaaaggagatttcgctacggcagtggaagaagcggaagcccggggagcgtccgtggaagaattacgtgagttattgggcaaaggacgtgccaagaaaggaatctttgagggcgacctaaaggaaggcgagttagagatcggacaggtagcgtctttattctgggaggaattatccgtggaagaggtgatgaaagaattgatccgtgactttaagcgatccttagagaacgtaaaaacacagttgtgttcgtgagaaaacacaactgtatctgtggataaacacaactgtgttcaagagaaaacacagttgtgttccttatcataatcgatacttatacaattgcgccatgaccttttggtattggttttgcaattgcaggtagttttgcacgctttggtaataggtcgtcacatccacgaaatactcgatcatagagatttgcccggcctgtatagccttgttcaacaagaccaagctattctgccttttcagcacatccttatattcatcgatagatttctttaaggagacagactggtcatatagctgcctcaacccattctctaccgtgaaagaagcgctctccaactgcatctccgtataacggacctgagccttcgcctgtttcacgttattacggttcgagaacaacgggatggtaattcctaccaagaaaccattgaaacgctctccacccgaggcgggattcatacgataccctaactcaaagccgggcagacctttcgccttattcacgctcacctgccgaagagctgtcgtctggtcgctacgcaaggtctgtaattgcggatcggattgcatcgcctccgtccgcagctcatcaaaggaaagcacatccttatccggcaaggcgtaaaccgtatccgtaaactcgatagcgataccgccattcaaggtagccagctcctgcagcttggcaatacgggaagtctcgttcatccgggcctctgtccgagcgttcaataattccagatcgatcttgtttgtctcaaggatattcgcatttcctttctccaaacgagtcgcataaaaagcggaaagttgctcggcgttcctaagacgggtatccaataggttcttctgctggttcaacagcaccaaatctaggcaaacctctttcacctgcaacaagatttgctgacgaaaagccatcccttgacgatccaaacccgcggatttcgccttcgtcagcttatgcttccggacatatacggacgggaaatcaaagctttgggaagccacgaactcgcccgtgaatcccatcccttctttattcccccagaaatgcgaataagagaccgaagggtctggcaaattattatccaacttcgcctccagcttctgcgactggaccaactggctgttcgcctgtaaatccttattgttcgcctccacgctccggagcacgtcctctatagaagtctgggcggaaaggccgcctgtcaatacagacaaggcggcgactataatatatgatttcataaaacttattctttattcttgttcattatcagataaacaatcgggatgatgaatccgtttaagaacgtagaggttaataaaccacccaagatcaccgtcgccatcgggctttggatctcattcccgggaagatcgccattcaacgccaacgggatcaacgccaaggcggaactcaacgccgtcatcaagatcgggttcaaacggtctagggaaccttgtatcacggactcacgcaatcccattccctctccacgcaaatgcgtatagtggctgatcagcagcataccgtttcgggtagcgataccaaacaaggaaatgaaaccgataatcgccgggatactgatctcgccggaagtaagccataggataatcacgccaccgatcaacgccaacggcaggttcaacaagatcacgccgctctccttcacgtccttgaactcattgtacagtaacatgaagatcaccaataacgacatcaatgacgtcagcaataaggtacggctggccgccgcctcgctctcgaactggccgccatattcgatatggtatccctccggcaaacggatattagcctctacccgatcctgtatctcattaaccacacttcgcaagtcacgttccgatacattggcactaatcacgatcttacgttgcacattctcacgattgatcgtattcggaccggtcacggaacggatatcggccacgtaacttagcggcactttctgtccggcggcatcgatcatcagattgctaatatcatccatcgtggcacggctagcgtcggaggtcttcacggtcaggtcgaaactcttgccatcatcgtacacctgactgacggcctctcctcccaacatcacattgatatattcctcgaactccggcaggggaatgccatatttagccaacaactcacgtttcggggtgattgtcaactgcggacgctcgatctgctgctctaccttcaagtccaccagacccgggatcgtttggatagcggccttgatctggttaccgaccgtaaacatcaggttcaagtccgtaccaaacagcttgatagcgatattcgcctccgtaccggaaagcatagcgtcgatacgatgggaaataggttgcccgatctctatattagcgccactgatcgtagataacttcttgcggacatcattcatcacctcatcccgactacggtcttgcaattcgaaaggagcctcgatctcggaaacattcacgcccaaggcatgctcatccaattccgcacgaccggtcttccgagccacagtctttatctcgggcacttgcaacagcaacgcttccgcacggcgtccgatctgatccgactcgtccaaggaaattcccggaagcgagcttacgttgatcgtaaaagaaccctcattgaacgggggcaagaaactacgtcccaaatgaaagaagatcaccaaggcgaccacaaacaaagcgatcgtggtacctagcacccatttctggtaagccaacgctaactccaaagcccgtttatacaccaccttcaacttccgggctatccaagcctcacgcagttccttcattcccgtcgctttacggttcagcaaatagctacaaagcaccggggtcaaggtaagcgccaccaccgtagaagcaaacaacgccacgataaaagcgatacccagcggaaccaacatacggccttccataccactcaagaagaacaagggcacgaagctcaccacgataatcaaggtagagttcaagatcggcatacgtacctcacgggaagcgtcgtaaaccacctccaaggtagagcgttgctgatccggaggcaagagccggttttcccggattcgtttatacacgttctccacgtccacgatagcgtcatccaccaaggaaccgatagcgatcgccatacctcccaagctcatcgtgttaatcgtcaatcccatgtagtgcaatacgatgatagagaccagcaaagataacggcaaggctaccaacgagatcaccgtcgtacgtatattcatcaagaacaggaacaagacgatcaccacgaagaaactaccctcaaacaagctcttctttacattattaatagagttatcgataaaatgactctggcggaatatatccgtagagacatgtacatccgccggcaagttcttccgcaaatcgacaacaatctcgtccagcttctccgtcaacttctccgtactcgtatccggctgtttggtcacggtaatcagcacggctggctttgtccgctcggaagcggttcccagcttcgggcttttaccgccgatcttaaccgtagcgatatcacccagcgtaaccggatactcattcacggtcttcaccacaccctgagcgatctcttccgccttcgacgtagacaagactccccggatgatatactcattatcaaactcatacaatacaccaccattggcattccggttcatattccgacaaacatccaacacctcgttcaaccctacaccgtagtgcttcatacgagccgggtccaacaagatctggtactccttaatatcgccaccgatcacggcaacctgcgccacaccgcccgtagacaacaaacggggacggatcgtccagtcggcgatcgtacgtaagtccaacaaagacgtggaatcggcggtcaaaccgagaatcatcatctcacccaagatggatgactgcgggcctaaggtcggtttacctacgttctcgggaaggctctcacccaagacagccagtttttcggacacgatctgacgagcccggtaaatatccgtaccccaatcgaactctacccaaaccacggagaatccggtggtagacgaggaacgcacacgccgtacgtccatcgcaccgttcacggcagtctccacagggaatgtcaccaagcgttccacctcctcgggagccataccgttcgcctcggtcatgatcacgaccgttggggcgttcaagtccgggaacacatccacgtccgtattaaacgccgtgtacgtaccccagatcatcagcaatagcgcacaaaccaagattaccaaccggttgtgcaatgaataataaattatcttatttaacatgcaacatccctcctattaatggctatggctatgagccggtatcgcgttagaagcggaagacaacttgatctggtaagcgccacgggtcacgacctcatcgcccggtttcaatccggaaaggatctgtacctccgagccgttattcgctcccagcgtcacccattgcttcttatagccttcctcatccagacggataaataccgaataaacgccctgctcctcgataagggcggagacaggcacgctcaagacattctccatcggctttgtcaacaaaaagatctccacgaaagaaccggggataaccgctcctttattatcgaactcgaaagtcaccggtacatagaaagagttcatatcggaagcctttccatacgataacaaccgtccacgcaaatcagacaatttatagagagcgttatcatacggagtcatgaaattagcggtttggatcatgggaagatcgttgtaatacctctcagacacgtccgcacgcaataccaaacgattgttttgcgagatcgtagccaaaggctgacctacggatacataatcaccctctttcacttggatgttcttcaagtaaccgttcaagggagagactacagacacgcctttcgccgtctgttttcccgctatcgcctcataagcgaccttggcgttctcgtaattcaagcgggcctgctcgaaatccttggcggatacgatcttatcgcctaccaaggcttgcatacgctcgtattcctttttcgctgtctcataagcgaatttagcctttgccgccacgtctccatcagagagggcgttggaagcgatactcaacacggcctgtcccttgcgtaccgccgtaccatccacgaacggcaagctaccaaacgagatcacgccgggaacggtagcgacgatcacggactcctccccttgcgccgccatcactcgtccgctcgtcttaatcacatccgtgaaaggagcgggattaaccattacggtctgcaaaccaacggcctcggctaaggctttcttaaagacaatctcgccgggatgggtaccaccggcctcatgctcatggtcatggccttcgtgttcatgtccctcatgatcatgatcgtgagcctctaattcatgattatgctcatcgtgtccggcttgcgacgcatttcccgcacaaccggcaaacaggtaagcgcacatcgcacctaccaaatatattttcttcattgtgtaaaaaatcttgatatcgttaataataaatagataggggcaagtctgtcctcacccgctctcacaaacgaggtatcaagacataggaggggcacgaagtcccgaggcactcactatccaagtatcgtgcagcgactcaatgtagggggcgttctcgtgatcaaggagctgtccgcaaaacgccagttcaggtggataaatgtaatcaaataaaacgagtaacggcatcagatgtatatccacatctccatccataaaatgagaaatatgcgtactgaaataggccaagttatgcccgtcgcaaccgcaatcatgcgtatcagtgcttttatcgccatgcgcttgctccgcggtcaaggattgataacaaggcatcccgtcccggtgatgatggtgagggataaccacagaaagcaatgccaagatgccggccatcagcaccacgtattgtacaaccctctgtttcattttctcacgcatggcacaaagataaggatatttttccgttttttacatgaatgttgtaagtttgcggtaaataaaaagatagatgaagtttggagtaaataaaaaggtattattatataccgccggttgcgtatggattttcgccggtatcaatatcttacgcatcggtatcgtcacatggttaaacgatacccattattggttattcaagatcggagaagcgaccatcgttttcttacttttcttcaatttggtctttaaacggcttttctataaacattccgaacggatctcccggaaaaacgggaaacattgcccgttctctttcttcgacgtgaaaggttggattatcatgatcttcatgatcgctttcgggatcacgatccgcacgttccatttactgccgaattctttcatttccgtattctatacgggattatccacggcgttgatcataacgggattcttattcttgagacaaggaaaaaccgttgggaattgagaattgaaaattaaagatacaacaatcaataattttcaattctcaattctcaattttcaattcccaagcttttcgcagatcaactcagccgccttcttgccgctcatcagcatgccgccaaagatcggtcccatacggaagctaccgcttacgccgttagcggccataccggaaacgaataatcccgggtagatctccttcgtgttctccaccgtcgtctgctcacccagctccacattcaaggaacgctcgccgatcacgcctccggtcggtgtattcaattggatatcattcttacgggctaccacacgggcgatctcgcaatcatgccccgtaccttccaagacagcctttgccatgatcgtcaacggatccacgtgcatcccctcacggattaccggagcccagttcactaccacaccagctacggcatcgttatgaaacaccacgtcctctaccgaatagcagttaaagatcgtagcgcccgccttcgtcgcctgataaatcaaagcggaagtggtatgtaccgaatccatgatatacgtgccgttagcaccctccttataacttacgcccaattccttgataatcggcatagcctcttcctgcaccacgatatcgttgaacatcatagcgccgccccacatacctccaccgggagccagcttacgatcaaacaacgccaccttcttaccggctttcgccaagaaataagcggccacgataccggaaggtccccctcccacgatcgctacatccacagacaagttgctcttcaacttctcgaagtaagagtcaatgattccacttgaaacaatctgttccatcttaataactaattaaagtttaaacatcagggagcacatagaggtaacgccccctttatttcctagttctaccttattttcccttcgccggcattacccggatcaggttcgatgggtataatctcagcccgtatgactcgggcacccctatgtgaaaagtcgggggcaaatgtacaaaaaattagtatatatgtactcaacagagccataaaaggcaaaaaacgctcagccaaacaaaatgtaaaaagtttagtcttcttccgaccagtcatcagaccaaccgaattctttatcccggaataattcagctaatcccgaaatctgcttgaaccgaagtaactcatttttatccattccaatattacgcatgatccacttatcagacatcccagatttgaccaactccgtaacaatctccgtcataagttccaagttgtgcatccctcgagccctgttatggcgaatggttgaagccattcggtttgaaatatctttctcaatcaccgttactggcaacattcctttctcacgatcataaatcctttgagattgcttcataaccagataacgatgataaccatctactatctcatataaatcatcctcttcaagataataacagacgcaaggcatcgtatagccatcctcccaaatggaaagttccaataatcgcatttccggtggtgccatgatattagggttatagctgttggctacaattttttctatagggacagccctaacaccatatgccggactaacaaagtttcccatgcttataaaaattatatttgtccattacttcttttctcatatccctttctcgttttgtctgggaaaaacccatatacttacatgtatgatcgtttttcaaaatacaaacacacatacgtttgtaagtagggatttctttaaactcaggtatattgatatcatcgatatactccatccgtaccggtttcttatccgtatggtaagcggtacattcttccacaatgataggaatattagccgcccgtaacttagcgatagtctcctcactgaggcatcctcctttttctctccagaatttacggctgactcttaacttattcaaatagttctcacgagtttcttcgggtaaagtatttaggagaaaatacatatatttctcccaagagaacccggctgggcacttgatagccctccatcccatagcggaggtattcccatatataccggcaaagccaacaccgtttacacgtccaaccatcctcccccacatgtcgggatcgacaactttgtaaatgaacagtgtggatatcgcttgggatatgaatgggctcgccacacgttgccgggacaaaggcacccctgcttgataatacaaatcatacaaatgattatatgtccaaccgaactttccgttcgctatccagatatcctgagttttccaatcataaataggatatgcgttatatatagaataattcattctgcgagtccatttataattagctagttttctgtaattcttatcactatgtatggcccgccacctattaaaactctcttgggtacggataccaacaaggcaacatatacgccggcccattttccgttgatacaaccaaaaagggaacatattctgaaaatcataatcccacatgtcctccttgaaaaagtcaaagtctttcgcccggagacatgaatggggcatctctcgaacccagatatcccggtactcctcgctccaaggtctccaatattgttgaaacatagatgtacatgtctggactttaaaaggaacacaacaatgataaatatcaaggatatcggaattagcggcataaaccttttccacatattcggtcgtctggctgtattgaacctcataatccatatgaaatacacctaattttcgtcccggagcgtatctacgaatataatctacacacaaattcaacagtacaccactatcctttccgccggaaaaagagacgtatacgtaatcgaaataatcaaaaatgatcttcaatcttttctctgtcgcctcgtacacatccattcttcgcatcatgactctacctccggtaaataatgcattttatcataatttttccactcaacacatgtctggaactttttttgtgagaacacttttacatgacgtttatgcacaacagccataagtgaagcttgagatgaaaaatcctttatgacttcttcaagaagttcactcaataccgaaggatcatcaccactcacgaaataattgtctatagagtaatagagatgtcctttttttacaggcataaaaccaacaacagctgtttcatgaaaggctatataccaaacgtggctacgagatgttttaaaagggtaattgttattttgtcgcaaaatggctggattcatgaccaaaggtgcgacaagttcatataacaatttgtccgttccctgcaatgtcataattttcatggtctgcacttaataatattaccatgcaaatttaggcattatatatagataccgtagccacaaaaacacaaaaatgtaatttactctatttatatttagtcactcgctcataatcgataacgcctttccaattcatacaaaaagcgaaatcatacagatggccctcgctatccgtatagcatttcatatcccggggaacatcttcgaattgctcctccacgatacgcatatctgccggcatctgcaaaggcaacaaagcggaaggctcggcttttccactgatgatatccaagaccgcttggttttgtacaccgaagttcaccagaatggcatccgccgaaccctcgaactcggacataatcgtaggcttatccatctccaaagatacgattacaggcttacctttcattttagcctttgtctccaaaacagaaagcatatcctgcttattagctgttttcacggacttacctttataagaacggttcgtgaaattctcaaacggatctccccccgccaaacttgggttacgggcataggtagcggtataatcattatactgtaaactgataggcatataaccgtttccacctttctcacaatcggatttatcataccccgtaccactgttcgggctcgtcataaagacgatggcgaaatccgcctcatcgggattatcaacgaccgtaagataccatgaccgataccctctactaaagcttgcgcattattattccagcgagccgccactttcgggctttgcactctcgtaaccaatacatgacgaacattatcctcggtgaggaatttacgctgcgcatcggaaagatcggatggctgggctccactctcatcaaaagatttgccattgtaggtagaagttccaaaccctttcgaggcaccggggatagattgatgggcgctataaagcatcaatccggcgatttcctctgtagatactgtccggccaaatcaacggcacgttcctcgggcgtaagacgccaatcctcatacggatcaagccgcccgttccgattcagatctttgaaggcatatccgtcaacagtaagaagtctcacccccgaattggcggaatatcctaatacagctccttcttgctgggtaacgatacggatagaatctttctccacctccgtccacttcgtgcccgaacaagcacaggtggaaactaacaaggcgcccaacataccatgggtcagccgaacagtaataaaaggttttcgcatactttcttagttttaataggttaatctctattcaataatggtttctcaagaatacgatttatccgaaatgagacggacgcttattcaatctgcgctcgataaagcttttcataaattccacggtctcgtcgatccctaatacggatacatcgatcgagaaattataagaagaggccattccccatgtcttattcgtataataattatagtaagccgcacgggatttatcagtcttctccatcatgttcttcgcctcttccaccgtcacaccatgcctttccacggtcttttggacccggctctccactgaactatggataaagaagctcaaacaagccggattatcccggaggatataatcagcgcaacgccctaccaaaacacacgactcagtctccgccaatttacggatagcgtcactctgtatcttaaaaagaccgtcattagacaaaatatcattataaggcgtaaacatccctcccataaaagaagaataccccatcgtaaaagcgtacgataaaccactggaggcacgttcgtctgccttctcgaaaacatcctcgcataatccactctcacgggccgccacggtaatcagttccttatcatagtaaccgatacccaactccttcgccaaacgttgtccgatctcgcggccaccgcttccgaactggcggcctatcgtcaatatgattttattatccatagatttcaagtttaattcaaccatctacaaacgtacaaaattatttttaaagccacgataataatataataaacactaaaacaaaaaataatcaaagtttatacttacatttgttttcgaataaatttagtacactcaatttatcatgaataacattcattccaatacaacatttcttaatgaggctatagacaagaagaccgatgtagaagatgaaaagaccgacttgattttggccaatatgattgatttgcgaaaaacgatgtcggatgtattgtcacttcttcttggagccaaaaaaaactcggttattgaccaagcgctattccgcatcttacaatttttcgatgtggatcgggtgtatatcggaacatttgacgaacaaactcatactgttgattttacgaatgaagttacttgtgatggcattatctctatgcgagaggatttactgcgtcaactcccgcaagacgagattccttggtggtacgacagtatcaaaaagggcatggatatcgttattcatgatgtctctaaaatgccggaagaggcgaagagtgagcagcatcttctgattttgcaagaggtttcatccttattagtcatccctattttcaagcaaggcaaaccatccggatttatcggctttgattctgtaaaaaagaaacggaactggagtgccttagatatagagaacttacatatgttggctgatatcctttccatagccattgaaagaggggaagttcaaggattagtagaacatacggctatgcaagtcatgaaaagcgagacgaagtttaagatcattttcgacaagatgccttggggcgccgaactttatgatgagaatggagtgttggtagatatcaaccaagcggatctcgatatttttggtgttacccgtgagcaggccgtgggactgaatatgttcgagaatcctaatatcccgaaatatgtaaaccaaagcctcaaaaacggaaaagatatattctttcctcttaattatgatttcaaggttgcttctcaaaacggctattacgatagtcatcatgattctaaaacaaagcatctgttggtaaaaggagtcacattaaaagactctcttgataatatattcggctatatttatattgtattcgacgataccgagaatcacatcaagcgggaacaaatcgaaaatagcctagcccggctaaaagtatcggtagataccggggattccattctttgggaatacgatgtagagaatgataaattgaccgtagattttggcctcaatgaagacattaataataatgaggggctaaaagcgattcatgattacaacttcaagaatcaagaagactataaatcctcaatccatccggatgattttgaccgggtatataataaacagttcaaacctctcctgcaagggaagatcaataacttcgtagcggcctacaggcgtatcctcaatggcaaaacattctggttcaactccaatgtacgctcctataaattcaacgatgacggaacgcctaacaggatcgtaagctatacctccaacataacccagcaacgggaaaaggagatcgagctaatcaaggtaaaggaagctgataaattgaagtccgcattcttggcgaatatgagtcatgagatacgcacgccgctgaacgctatcgtcgggttctcaaatataatcgccgagattgatgatgaggtagagcgtcaatcttatttagatatcattcataaaaacaatgatttgctactgcaactgatcgatgatatccttgatttctctaaaatcgaggcgggaaccatggattatcatttcgaggaagtggacatcaaggatatatgtggcgaaatcgcattggcagactctataaagatgccttcagacgtggttcttatctttgatctcggctccccatccgtaatcgttaaaaccgatgagcggagggttatgcaagtgatatctaatttcgtgaataacgctatcaaatttaccacaaaaggaagtatcacgatttattatgagatagaaggggattttatccgagtctgcgtgaaagatacaggtatcggtatctccgcggaaaaccaaagacgtatattcgagcgattcatcaaggtagatactttccagcaaggtacgggattgggattaaccatcagccgaaccattatcgaggcattaggaggtaaaatcggcgtagactctgaagaaggggtgggttccactttttggttcactctgcctttggacacaaaacggactgatattgagctttcaccggatatccccgtccaatccgaagaaacgccccgttcagataggcatcattccatcttaatcgccgaggacgtttatgagaattatttccttttggaaaccttgtttggcaagcaataccaactttatcatgcgctaaacgggcaagaggctatcgatatgttcgagacatatcatccggacctaatcctgatggacataaaaatgccggttatggacggattcgaagcgactcgcagaatccgcaccttatccaagaccattccgatcatagcgctcacggcattcgctttcgaaagggaaaaggagatcgccaaacaatgtgaattcacggattatgtagtgaagcccattgatataaaagaactaaagaaattaatcgttaaggtattggcataaaaaagcgtgttgcgacaatcgcaacatgcttttttttacttaggcatcggagcggcagaaggaggaggcgttcccaatccccattccttattcgctttcggccccatctctaactctaacaaaccaccagcggcgatatcgctatgattgaaccaaggctggttcaaggttacgccgttcaacttagcggattgtacgtatttattctcatcggatgcgttattcgcacggatctcgaacgtattgccgttacccatatccactttcacgtcggtaaacatcgggctaccgatattataggtaggagaacccggagtcaccggatagaatcccatctggctgaaaacaacgaaagcggacataccaccaccgtcctcatcgcccggcacacccatcaaatcattgcggaaccattgattcaataaggtacgaatacgtttctgggtcatccaaggcttacccgcataattatacaagtacgggatatgcaagctcggctcattcgccatagagaacatacctacgttacccgtatgatccggaagcgtggaatagaattgccatttagacatacccagcggcgtattgaacatggaatccaaggcagaggtaaacgcctcattgcctccgatcaaagagatcaagtcaccgatattatgctgtacgtcccaacgataaatatatccgttattctcatcgtaataatcacgggcacctagaccgccatcataacggtaatccaatggatagataaacttgccatccttatctttcggatggaagaaacctgtctccggattaaatacgttccggtaattgtaagagcgacgcaaataataatccgcctcgtctttctttcccaattcttgagcgatctgggacaagcaccattcatcatacgaagtacctaaagtcacggcgatcggctgacgtttttcccaaatggatacgttaggcaccgtctctttctctcccggtctcaatgcgggaatatagccatgttccttgtagaaatcatccaaccaaccggcgggagcggcagaccacgggatcaaggtcttttcctcgatacctttcttacaagcgatataggctttttccagctcaaacccacgcaagcccttgcggtaagcgtcgatcacggtagcgacagcatggtttgagttcatacggcgtgtatctcctgtcacctccgggaaggtaggcatccaatcggtacccatctgctccgccatcaggagataagagttgatgatatcgttctcacgctcattatcgatcaagacacgcaggggatgtgtagcacggtaggtatcccaaatccagtcgtccgtatagaaaggccgtccgccatcctcatggatctttccgtcgaaagcactgtaataatgtccgtcctcgctcaagtttatcgggcgttcgtagcaacgatataaagaggtatagaatacggtcttctcatccttggtaccaccttgcacttgtattttacctaaagcatcgttccaatcgttgcgggcgatcttcgctaccacatccacgtcgtaagcggcgatctcacgctccagattcttcttcgcctgttcctcgctgataaaagagataccgtagcgaacgccaagtttcttcacgtcctccccgaaggaaagggcgatagcggcattggtaccttccacggaggtctcgtcatatttgacactgccgtttgacaatacacccgctttcacaggcttctggtttgtctcggcatataaaaagactttcgttttcttatctatatattgataaccgcttacggcgttaccatttacttgtagctgtccgttacggctgttaaataccagataagccggtccctctttctcgaaagtgagcgaatatacggcactttgatgggacggggcgaagtccacgtcgatttccccattatccagatatacctgataacggtatggcaagatcttctcccggtcatagctataagcgatcacgggtcgcaagccggattcgtcaccttgataagggcataaattgaacgcagaacgctcacgatggtttgtcacgataataggcaaaccgcccagacggtcgcccgtgaagtccgcacgctccggatatacacgtagcatactgttcggcaaatgcacggtcgggaaagtaggcaccaataaatggctgatgtttcccatataaggattcacgtaatccaccgggtccatcgccgaaggaggagtccctccgccaccggcgcatgacacccataggaaagcggaagccaaaagggccatcgaagttttaagctttgtcttcattttgtcgattattaattcgttaattattctttgcttctcagccgggtactttcccggcaatccgtgagacgttgtctcacgggtaacagagcaaaccgctcactggtaagggagctatttactcagccgtcttcggacgattttctggggcagctccgaactccttattcggcgtgttgcccatcacaaaggtaagattccctcccttcacgatatcatcatacaggatataagaattgttataaggtttaccatttagcaacacggattggatatatacattctccttgctgttgttctgggctacgacctcgaaagttttaccctccggcaaatgaacggaagccttatcgaataacgggctaccgaacacgaatacgccattggaaggattcacttggtaaaatcccaaggcagacatgatatgccaagcggacatctggccacaatcctcgtttccgatgatgccttccggctggtcggtatagaacacatcttgaatgtaacgaactttctcggctgtcttccattgctcgccggcgtaaggatacaagtaagtaacatgatggctcggctcatttccatgggcgtacatgccgatcaagccactgatatccggagaggcgttctctcctaactcaccttccaccaagaacaaagaatccagtttcgagataaacggagcgtcgccacccatcaactcgatcaagccttccggatgctggggcacgaagaatgtataatgccagccatttccctcacagaaatcgcctacgctatgtatggactggatcggatcgtacggcgtacgccagctgccatcattcattttcggacggataaagttgatatccttatcgaaatactgcgtataatatttaccacgtttcaagtaattctggtaatcctccgtcttgcccatttttttcgccatcaaggcgataccccaatcatcagcggcatattccatcgcgatagaagtagcctcacgtaccttatcacaagggatatagcctttttccaacacgtacggcaccccgttttgcttctcatagacagatgaagcaaccatataacgatacgcacggtcggcgtcaaagccggtaaaacctttcagataggcatctgcgataataggcacagcgctatatcccggcatttggtccgtctcaccaccaatcaacggccagatcggtaatttctcttgctggtcgtaaatgcttaacatcgagttcaccaaatccgacacatattgaggcttgataatcgtgaacaacggatgcaaggtacgatacgtatcccatagagagaaagtggaatagttcttccaagtattgttcgtatacaccttatcgtcatggccacggaaatcgccattcgcgtcgcaatacaacgtcggagcgataaacgcatggtacatggcggtatagaaaatcttcttggcacgctcatctttcgtatcgatggagatacaagacaattggtcattccatttatcgatagcctcgttacgaacctcgtcgaaatcccaatgagaaagctccgtacgtaagttagccaaggcattctcacaacttacggaagagatagcgacctttaccaaggcggtcggggcatctcccttaaaggtaatcactcccttaacggactcgcccgtcaactcatcattacctgcggcctcatcatcgttgaatacagccaaagactcgatcggctgatcacatttcaacgtaaagaatactttgtgacgtgggctccaacctttggaaaagcggtacccctcgatcgtgtactcatcaatcttcttcaaataagtgtcatacgctttatcaccgataccctccttcaagttgatcaagaggcgatgctcacttcccgacggatacgtataacgatgtaaggctacacgctcggtcgctgtcaactccgcctttacgccattatccatcagcaaagagtaatatcccggagctacggcttcgttggcatgtttataataggaagaagcggctccctctatattatcttgctcgccacgggcggtacgtacctcgcccgtataaggcatcagaaggatatcccccagatcagaacatccggttccgctcaaatgcgtatgactaaatccgataatgatactatcggagtaatgataaccggaacaccagtcccatcccttaaaaatattctgaggacctacttgaacagctccaaacggaacgttcgccccgacaaatacgtgtccgtgttctcccgatccgatataaggatctacatatgcggtaaagtctgtcttgttttccatcttctccggtgtagcacaggagtatgcgaaaaatgtcaggcatatcgctatgcctgacattaatggtttatgaatgaaattcatcttaattgcttatttcttctttttactaggttttacagaaataggggaaagtttattgatcccttcctcgtttacggagaatgagtaaggcatatcctccggattaataccacgattcatattcggcttgtcacccatcttgaagtcgatcacgccacccttaaacaaatcgttatgatccaaataattcttggtgtagttcttgccgttgaacgtcatagattcgatatagatattcttatcgctgttgttcggggcgttgatcaccaagttgtttccattctcaaaatggatcgtagccttcttgaacagcggagcgcccaacacatattgggtcgtacccggagctaccggatagaatcctaacgcggagaatacataccaagcggaagtctggccattatcctcatcaccgcaataaccatccggacccggagtatacatcttattcattacttgacgcaaccaatattgagccttccaaggttgacccgcatagttgtataaataaatcatatgctggatcggctggttaccgtgagcgtagttacccatattcatcacggtcatctcgcggatctcgtggatcacaccaccgtagtagctatcatcgaacaaaggcggtacagcaaatacggagtcaagcatcatcacaaatgaatccttaccgcccatcaagtcgatcaatccctgaggatcgtggaatacagaccatgaatagtgccagctattaccttccgtgaaagcgtcaccccatttcagcggagagaacggagccatgaactcgccattctcattcttgccacgcatcaacttggtttccttgtcgtacaggttcttatagttcaacgcacgacgggcatataaatccaattcctttttcggacggcctagttgtttagcgatctgccagatacaccagtcattgtaagcatattccaatgtacgagcggcattctcgttaatcttcacatcgtaaggaacatatcccaacttattataatattcatgccccagacgtcctgtagaagaaaccgtcggatgaacgttttccgtaccatggatcaaacctttatatagagtctccaaatcgtcaaccttcacgcctttcatataagcgtctaccaagatagatgccgagttattaccgaccatgcaaccacggtggcccggacttgcccattccgggaagaagccgctttccttatacgtattgatcaaaccctcttgcatttccttgtttacagacgggaacatcaagttcaagaatgggaacaaactacggaacgtatcccagaatccggtatcggtaaacatataaccgggtaatacctcaccattatacgggctgtaatgaaccacctcgccttgagcgttgatctcatagaacttacgagggaacaacaatgaacgatagaagcaagaatagaaagtacggtattgatccaaatctccaccttcaacctcgatcttgctcagatgctcattccaaacatccttacctttctgaaccaaagtatcaaagttatcgttacctaattccttcatattgatagcggcctgatcgaagctaataaatgaggaagccaccttagcgtggacgatctcacctttcttcgtcttgaaaccgataacggctcctacatggtcactcgtttgttccttcgttccctctttcaaggaagcgtcagcaaatgtagcctcgtatgtgaaaggtttatcaaactcgatcacaaagtaattcttgaaattatcgggaaccccaccgctattcttcgttgaataaccgatgatcttattctcctccggaattaccttgatataagagcccttatccaaggcatccaccacgatataagaatgctcgttttccgggaaagtgaaacggaacatagccgcacgatctgtcggcgttaattccgtcaccacatcatgctccgccaaatataccttataataataagccttggcgatctcccctttgtgagagaaccagctcgcacgtttatcttggtcgaactccggtttaccaaccaccggcatgatcgcaaattgtccgtaatcattgatccacggacttggctgatgggtctgtttaaaaccacggatcttgttagccgtatatacatactgccatccatctcccatcttaccagtctgaggagtccagaaattcataccccacggacgagcgatagccggataggtatttcctgtagacaactcataggaagattgcgtccccattagcgggtttacatactctactgggtcaaaagactcattcacagccgctgccgcaggtttccccacccacatcagcatcgccgctaaagctaaagcccaaacgctttttttcttcatgatatagctatttaattaataatataatttatccgtttttgtgttttatattcatagttagactacaaatatccatttaattaacatgaatagaaagtgatcctcgtgtcatttatttagaaatatccctttctttcttatgaatttctggcattatacgaatataggtgcaaatctaacaaaaagaattagaaaaaagaaatccaatgagccagatcatactctgttcatcgcacttttatcactatcgaaaaagattaaatatcacatgctagttccgtacgaactatgtctattctagaatataatattacatataaatgtaatcaatctaaacttaatttaaaacaagagcaaaatgacaaagaatgaatctaagctattatcccttcaagggatagctaaagcctcagcgttctgtttgttgctttccgctttttctgtaaacgccgcaatggccgctcccgctcccgcaggcacggttgatgaagtaatggcagtgcagcaaggcaagaaagtaacaggtgtggttgttgacggtacaggtgagcctgttattggcgctaacgtggtggtgaaaggcactacaaacggtacgatcaccgattttgacggtaattacacgatcgagggtgtgtccgcaaacgatgtgttggtcgtttcttatatcggttatctgtctcaggagatccctgtgggaagccaatcagcgattaacgttactttgaaggaagatactcaaactttggacgaggttgtggtcgtaggttatggtacgatgcgtaaatcagacgtgactggctccattggtgtggctaaaggtgatgacttgacaaagaaccaaaactttagtgcactagacaatttgcgcggtaaagtatctggtgttaacatcttctcaaactccagccagccgggtgcttattcaaaccgtgtcgttatccgtggtatggctactatcaacgcttcttcaaatcctctatatgtagtagacggtgtcgttatggagaacttcgatttggtgaacccgaatgacatcgagtctatggaggtattgaaagacgcttccgcagccgctatctacggtgcccgtggtgccaatggtgttatcatggtaactacaaagcgtggtaagaaagatggtgaaggcgtacaggttagctatcaaggttctgtcagtgcaagccatatcgctcgtaagatggatacgatgaacgcccaagaatggtgtgatgcattcatgattggtttggaaaacgagaataagtggcaaggtaaaaattggtctttgaaccgtgctgattggtttaatgattcaaatttctttgatgcaagcggtaatcctctgtatgatacgaattggcaagatgaggcaactcgtaccgcagtttctcacaaccatcagttgaatatacaacaggcaggtaagaactcttcaatgggcgcttttttgaactatacagatcagcagggtatcgtaaacaatacgtataataagcgtattaatgcgaaattggcatacgacgctaatcctacgaagtggttgtctacggcggtcaatgtattggttaaccatacatggggtcgctatacgcctgaggatggtggtggccaagaggctcgtcgtaccatgatcgaaatggttccttggatgccgattcgcgataaggatggtaaatataccacttctacctcttcttccattggtgatgtattaggctttgagggtatgtctaaccctgtcatgatcttggatatgcaaaaacgtatgcgctacaacacgcaggtgtttggtaacgccgctttgacatttcatttggctgaaggtttagatttgaaaactcaattaggtcttgatcaccataatagaacgtatagaggttattcttctatcgatttgaacaacatctccatgccgaacggttgggctgagtaccaaaactggaatacgctttattggcaagaggagacttacttgacttacaataaggcatttggcgatcatcgtatcaacgcaatggctggtttgtcttggcaagagcgtgtacagaaatggaataaggctcgtacgacaggtttctcagatgatttctttgaggacaataatatgtcagcaggcacaacacctgatgctcccgaatcatcttacgatcgttgggcgatgaactcttatttcttgcgtttcgcttatacatataaagatcgttactccgcaaccgtaacagggcgtgtcgatggttcctctaagtttggtgagaacaacaaatatgcgttcttcccatccgctggtttggcatggaatgtcatacaagaggatttcatgcaagatcagaacacaatcagcaacttgaagttgcacacaagttatggtttgaccggtaactccgagattgacacttataagtcattggcaagtgtttcttccggtacgcttcttatcaacgatgtacgtgctccgtattcttacatcagttctatggctaaccctgatttgaagtgggagaagaccggtcagtttgatgttggtttcgaaattggattttggcagaaccgtttgtctttcgatctagcttactataacaagaagacaaccgacttgttgttggattgcccgattcctcacacgacaggtttcactacggtatataagaacatcggttctgtaagaaaccaaggtatggacttgatgatcagcgcacgtccggttcagactcaagacttcaactggagttctacgatcaacttaaatttcaacaagaacaagatccttcagttgggtgacaataacgaggatatcgagatgaacagctgggtaggtggttctgaaagtatcttgcgtgtaggtgagaacatgagttctttctatggctacagacgtttgggtgtttatacggaggaagatttcaacaacggattgtgcgagaagaaccagatcggtcgtgcgaaacgtacggataagaaagagatcatcggcaaaggtatgccggactggactggaagctggatcaacaacttctcttacaaaaacttcgatttgacgatggacttgcagttcgtatggggtgttgagacaatgcaacagttctaccactctacttacgaccgtttcggtatcacgaatggtttgagcaatattttatatgacgcatataacggatcgaacccgaacacgatgcaacaggctgtttacttatgtaacgcaggccatgcaggtcaggatacgacagtagattctcaatggatcgctaatggttcttacttgcgttgtaacatgttgcaattgggttatacttttgactcaaacgtgattggcaagatcggtttgtccgctttgcgtttgtacgcaagtgcgaataacttattcttgattacagctagcgatttcactggttacgatccagagggtacatcacaaggtgatagtaataagttcggtcagaacatggtattcttctcttatccgagagcgagaacattcacgttcggtgttaatgtaacattctaattcatttaatcagtagagtaaaaaaatgaaaaaaatattgacagtagcgattgcatgtgcttgtttaaccgggttcagctcatgtaatgatttcttggaagagaaaccgcagtcatcgttgacagccccggattattaccagacagaggctcaagctcaagctaacgtgaactatttgtatcgtacaggagcttcaaataagctcacaggtgcgggtagtgcttatgttggtccgtttgcctctatcacaggacaattgactggttactttacaaacagttatgaaggtcaggagttgacttgtaaatattctcgcgagttgactcgtcagcagaatacgatgactgtttccgtaactattgacggtatatgggatgattgctacaaggctatcaacgtagcgaatggtgcgatcaagcatattccggaaatctcgatggatcaatctttggccaatcgtctggttggagaggctaagttcttcagagcattcaactatttcaacttggtaaagatctttggtggtgttccattgacagtagaaccttacgaatctatggagaacatgtatttggagcgtgcttccgtagagcaagtatatgctcagatcgaatccgacctgagggatgccgttaatgcattgccggctgctactttctacaacaatggtaaccgtatcacgaagtatgcggcagcgatggtcttgacttccgtttatatgcaacaaggtaagtatgcggatgcggcttctgcggtaaagactgtgatcgattctccgcacgctttggcaaccaataatgacttagcgctaggttctgcctataataagatccgcacgacagacggactagatgagtctatttactcttatgaatacaacgctacgatcagtaacggtggttggtggcctacttatgcgttcaactcagcggctacagctatatttggtacgtattctatctttgagcgtacatacgggccaacgaatcaattcttgaacgtgtatgcagcaaacgacttacgtattcagccaaatcaattcttccattgggattatacaaatccggacaatggcaagacttggacggctcctaaggatgcttgtggctgttggttctggtatgatgaggacgctttgttgaactcaggacgttctacgaaagaccgcgatatctatcgttatgcggaggctttacttgacgctgctgaatctatcgctcagtctcaaggtgtaacagctgaggctgccggctatttggcacaagtcaaggctcgtgcaaacatggaaggcaagacggtagccgcaattactgccgatcttcagaaattaggtaagcaggcctttatcgaggaatgctggacagagcgtttgcgtgagttcccgttggaattcaagatttgggatgactgtttgcgtacaggcaagttccctgtaatctcttctacagagaagggtaaggttacatacgttgacttagttggcgcaaagaacgcttccggcgcaaccttcaagtcttccgacttgctatggccgatctctttgaacgagatgcaacgtaacccgagtttgactcagaatgagggctatgccgttcaataataaatttcaataactgatggctagagagggagggaatgagcgatcatccttccctctctttttggtagctcgattagtcagcgagttgcatgaaacaatgtataatatacagaattttggtttggttgtcttattattcactttcaactatgaaaacaaaagagcaagaaatgacatactggattctgctaagttagaaggacggttggaaggtgaagaaaaaagaatgattttctgagcagtactactgacttgctcaaaggatatatacttattttgcccacgcagtatatattactttgccaagtcactaatacttcataaacatcctttactttgacacaggctagaggataagcaattgcttccttctgtaaacaaaaaacgcccaaaattgctctctgctataaacaatttgttatatttgcatatatataagtacgattatggagcgattgatagagatgtatcgaaagaagttgcgatttacctctaccgcctttattagaagcacggtgtacgagattaatcgggatgcccggttgatcggtataagaggtgctcggggagtgtaccgcaacagcatatcaagcgaaattttccgcaagacgaacgaaccatatatgtcagcttagatagtatctatttctctgacaatacattatatgactttgcggatcgtttcgtgaaacgaggaggaacacgcttacacttggatgaggtacataaatccccccagtaaagccaagagttgaagaatatatacgatgatatgccagaactgcaaattatatttaccggccccttttatcccgaatatcagtaagctctgcgaatggattagtatcacgagaaacgttttattgacttatctaaacgtattggcagaaagtaagctgacctacaactgtttctacttttggtatctctcgcctgcaaaagccggacaatatctacttgaaaaatagaaatctgatgtatatcctctcgcctttgaaagcgaatatcggcaacatgcgggagacgttctttgcgaaccaattgaaaaagtctcaccaagtaacaaccttagatttacatccgagtattacagataaaatagaaaggataaatttgtaaagtatgagcgaagccaacgattttttggtggatggaatttatacgttcgagatcggtggcaaacgaaaaaggtactcaccaatagaagggataccggacggttttatcgttgcggatgatataaaaataagatcccgttatggatgatggggttcttgtattaaggaagaaagggaagaataatcactcatccttccctttcagccatcagttattgaaataaaaagtaattacttcgctgaatatccctcattctgagttaaattcggattacgttggatctcgtttacagggatcggccagtataagtctgttgccttgaatgtagcaccgctaccattcttagcgccaattaaatcaacgaattgaacctcacccttgtttgtagcggagatttgagggaatttacctgtacgaacacagtcatcccaaatcttcatttccaatgggaactcacgtaaacgctctttccagcactcttcaataaaagcttgcttgcctaatctttgaagctcggaagcgattgtagaaacatccttaccttccatgttagcacgtgccttaacttgtgccaaatagccggcagcctcagcgtttaccccactagactgagcgatagcttcagcggcagataataatgtttcagcataacgatagaagttccagtctttcgtacccttaccagtctctaagatagcagtctcatcataccagtaccagttacaaagcatcttcatatccagagttgttccatcaacaggatgcgtatatgtacgatggaagaactgattcatctgggcacgcaagtctttctcaccatacacattcaaataacgctcgctaacaccatacacatttacccacaaagagtatttgtttccagtagaagaattagcgaagaatgtcggagaaatcaaattgaatgcgtgaaccgggatattaccgttaggagaaatagctgcgtcatattcacgggcataaataacctctggcagatcatctgttgtacgtaacttattgaacgcactaccttccgcaaggttatcgttagtagccaaagcgaattttccgctattgattacatctttcaatggagtaaccgcattagcgtactctcctagtctcatgtaaacatcggccagcaacatatcagccgcatattttgtcacacggtgactatttcctgcaaaagtagcattaggtaaattctctacagcaaactgtaaatcaggaatgataactgtattgaaaacttccgatgcagccgtacgagtcggatattcaaccaaagtagcatcttctgtaggttctgtaaccattggaacatcaccaaacatttttacaagatagaaatagttcaatgcacggaagaaacgagcctctgctttatactgagcttgattatccatttccacaccatcaacatacttgataactgcgttcgctacattgatcgacttataacaacttttccaagtgtcattagtcaaataattacaacaagattgcgtaaagtcctgacgagtcaactggcgagcataggaacagtctacttcctgaccttcatattcattcacgaaataaccagttaccatgttcattacagacaagctagaacctctataagcaccagtcatattacccatcttatcgggagcaccgtcacgatatagataattgacattgccaataatatcagcacttgtcttataataggtatccagcgtcaaggatgactttggttcctcatccaaaaaactgtcacatgcggtaaatcctaccaatcccgcacataaaatagccgttgttaatatttttttcatcgcaattttctgaataattaattaattaaaatgttacatttacacccaacgtaaacgttctagctctcggataagagaagaaggccatattctgaccaaattgctctggagataccgcaccattagatgtagagatctgggatgtactttcaggatcgtatccattaaagtctttcgccgtgatcaagaatgcgttgttcacattcaaatataggcgtaagctactaaacggagtctttgccaattgatttgagtcgaaagtataacctaactggattaagttcgcacgtaaataagaaccattagccacccattgagagtctgtcaatgtatcctgtcctgcgtgaccaccgttgaacaaccagatagcttgctgcatagaattaggattcgttccattatatgcgtcatacaagatatttgtcaaaccgttagtttgtccgaaacggtcatacgtagagtgatagaactgttgcaaggtctgaacaccagcgacaaattgtagatccaatgtgaaatcccaattcttgtaacgtaatgtattgatcatagatccagtccaatcaggtacacctttacctatgatctcacgctcagaagaacgtttcgcacgaccgatctgtttcttctcacagttaccagcctcataatcctcgatcgtataaacgcctaaacgcttataaccatagaaactacctacactctcaccaacacgtaagatggaagcaccacttacccattcgttcttcaagatatcctcgtcattatcacctaatgataagatcttattcttattaaagttggcattgatagaggttgtccaagtgaagtctttcgtatcaatattgcgagtagacaacatcaaatccaaaccttggttacggatagaaccgatattcttataaactgtctcgaaacctgttgtatgaggaaccggggcatccaataacagatcagaagtcttcttgttgtaataagaagcatctaacgtgattctattattgaacaaacctaaatcaaaacctatatcgaattgagcggttttctcccatctcagatcagagtttggtaatctattcaaataagaataggaattacgtgttccattcaataataaggtttcgcttgtaactgttgccaaagatttgtaaacaccaatctcagagttaccggtcaaaccatagctagtatgcaacttcaagttgctgatcgtattttgatcagacataaagtcttcttgcgtgatgttccaagccaaacctgctgatgggaagaatgcgtatttattattcttaccaaacttagaagaaccgtcataacgaccagtaattgtagcggagtaacgatccttgaatgtataagcgaaacgtaagaaatatgagttcatagcccaacgttcccaataagtcttcggagcatcaggcttcgtacctgcgtccatattgaagtcctcaaagaaatcgctagtgaagttctctgtatacattctagaatagtcatatttacgctcctgccaagacaaaccggccatagcattgatacggtgctcaccaatcgtcttgttataagtcaagtaagtctcttcctgccaataaagagtatttgcgtgatatctttcagcacgtccatgttggtcatatgccaaattcaccaagtcacttggcatatatttgtgcaaagtcttaaagttagcgtcaacaccgaattgagtcttcaaatccaaaccttcgatgatatggaatgtcaaggctgcattaccgaatacttttgtattatagttcatattcttataagtcttcaagatatgaacagggttagacattgcctcaaagtccatcggcataccttctggagtattagtagaagtatactttccatcgtattgaaccggcatccaaggaaccatctcgatcatagtacgacgagcgtcctgtccaccgccatcctcaggagtagagttgccccaagtatgatttacagctaaattgaccgctgtagacaaccatgtcgtaggattggcgtcataagcgatcttcgcattcaaacgttttgaataggtattcagcatgatgccttggttatcagtatagttcaagaatgcacccatagatgatttctcgccaccttgctgaacattcaattgatggttatgagagatcgctgtacgagttgcctcatcttgccaatctgtatcataaagaggattaccgttagaatcgaagaaacgacgatctgtaaaccaatccgcacgattagtagaccagttaaatggattgccatccttatcagatccccatctattctcattctcaataccttgcataaaagcatcgcaccactcctgcgcattcatcgtatccatcttacgagcgcgatgagccaagcttacagaaccagagtagctaaccttcgttccaccttctttgttaccacgtttcgtagtaaccatgataacaccattggcaccacgagcaccatagatagcagtagcggaagcatctttcaatacctccatagactcgatgtcattcgggttcatcaaatagaagttctccattactacgccgtccacaacatacaatggatcagaagaagcattaattgtcgcttgaccacggataacaacacggctaccataagcacccggctggctagagttagagaagatatttacaccggcagccttaccacgcaagttatccaatgcactaaagttttgagcttttaacatctcttctcctttagctgtagaaatagaacctgttacatccgatttacgcatcgtaccgtaacctactactactacctcatccaaagtctgtgtatcttctttcaatgtaacattgattgcagattggttgcctacagggatctcttgagataaataaccaatataggaaatcaccaaaactccgtcggcgggcacaccctcgatcgtataatttccatcgaaatcagtgatcgtaccgtttgtagtgcctttcaccaccacgttagcgccaataacaggctcacctgtaccgtcaacaaccacacctgttactttcttgccttgctgcactgccattacttcatcaaccgtgcctgcgggagcgggagcggccatagcggcgtttacagagaaggcagaaagcagcaaacagaacgctgaggctttagctatcccctgaatggataatagcttagattcattctttgtcattttgctttgttttttaattaagtttagattgattacattgtctatgtaatttttatcgttatagatggacatagttcgtacggaacaatatatttttagtacatttaggggctgatattcttggtttcaaggggtgatttgtgataaatgtgtcatttttattaaaaaaatactatagatttaagtctagtttgcaaaaaaagttatacatttgcccagtttttaatgatatagaccatgaatggcgcactagttccgtacggacttacaatagtatcatcgtctttctatcacataaataattaactatcaaatattaacagtaaaaacactttaaattggttacaataaacaaatgttaaatttattgagattcaaggctaggcgaaaatggcactagtatggcttctatgaaaaaaacagataatatattcagagactggataatatgaaaaaatttagccttcctttataaataaaagaagaaccacattatctacaatctttctaccaagaaagcgccatagacttattcccacaaggcttgaaatccaataaggcattacccgaaacagagtctctcatgacactcttcacccatcactctaacacaagcaagtcttctgcttagaataatactgatttatttgggattagatcctatcaaaacattcaatatacaaacataagacaaactggataagggcgggcaaaccccgccccttaccatgctaccaagataattttataaacttattctcccacggagcgaaactcaacggattccccgaaactgggtctcctacgacatcacaaaccgtagttttcacaaaattaattttatctgaagctacggagaaagtagctggcttcccgcctatctcacgcaattgaagcataacagcattctcgccttccacaggcctcatgtttaccaacaacaaattctccggtacgatcttgaaaatggaagccgattggagaggctccacctttttatctccggcaggcaaaacacgggtcaagaacggaatccggttttcccaagcgaacttagtcgcatactcaatagagttgtctttcgaagagttgatgaagtaactccattgcatctctcccatttggtccgcattgaaattggttacccagtagttgttcatcggccatgaatacatattcgtggactgaggtacggctccggctttataccgccccgtattgatcgccccaaattgcattaatggtatttcttggctacccatcacgacctgtgactctccattacgagccgtagcgaagttttgcaccgtgtaccaatcgttagaggagcccgggatttggtctacacccgcctcaatcgatccgccgggtacatctaaatggatctttcctccttcaacctcaaacgggaaagcgatataaaccgcttccggatctgttaccgctcttttgcgcaggcgataaactacctcgattttctttgttacgttaaatacacggaattccaccatcaaattattcggctcacgtcccgctactgtctctccccggaaacgatatgtatcccagacatcgcctttctcatatttctcgaaacgcatcttctctgggcgacggcggaggaattggggagcacgatattgttccatcggatgacggctatcgataatctcataaataaactctcccatctcccattccgcatccggcgtaaccaattgtttgttcaaatccttatcacataatttacgaatcgtacctttacgggtattgaagtcgatggcataccaaggattctccacatgtgtctcttttaattccgtagtgccctgtatttccggacgtggcgcatccttcacctttatataatactgtgcgtatcccaaagccgggacttctttcacgtaaaagttccaataagtaccatcggaacggctttcgccggcttgtgcgggaattacgttgccagccgcatccacgatctcgaaagccttgtctttcggaagaatctgatgatcgacataagctttagcgataccgctataactccagttgagcgtattgaatacagcgatagacggaacgtcgcttttaggcacgaacgactgtaatatacccatagtggcctctcccagcaaaccggaatggcgataggcttcccacgcatacgattgcttcaaggagcgttgttcccaagtttccagtccataagcgttacgcacgctctcactatgcccgaaagtatgctcatcatagaacaaaagagctttgttgatatcataaatccgatcattgatgtctgtcggcaattgagcgcctagcattttggcgaatgacaatccggcttggttcgcgataatatccgagtgagtcacacgagatatggcggcctcgcgggcaccggaagcgaaaccatccgtccaccaatccggccaagctccacgaacggtctcgatacgatccgcatattggctctctaccgttttaaagaactcactggctaccgccgtgcgtaatttcggccattcatatttctcgttccatttctgtaacatctcgcaacttttagtcgaagggggcgcattatccgtaagatatcccgaatgctgtaccgctaatatatcatacggataatttttcgcttccatttcacctaaataagttaaaacacgttcctcgaactggtcaaagttatccgtatgaatcccgaaaaaattaccatagtgataatgctccgcacgataagtcaagaccttcttccctgaaggtgattcccaccaaaacaccgtaggtttatcaaagcagatcaacgcccgatggccatgggttcccatattcacatatttcacgccggcatccgcgaaatactcgctgaaacaccaaccgataccattcacgtcgtcttgcatagctacctcggcacgcatcccattttccctgaattgcttgatcggataaagagaagcggcaagtgtctgctcatccggtaattcgtcaaaattcaagaacatcgttgctaattcaatacggccttcctttacccgttgcttcaagcgagcgatctgttccgcaggacgacatttcaaatattcgctaaccgcccaagcgatctcgcaagtccaacggaacttagcgaaatccggataattatccgtagcatcgcaatagtccaacgcataatcaatgtatcgaagctgttccgccaagatttccatttgggaacgggtataaccgatatccgtatgcgtgtgctgcaccatattcatctgccaatggcgaaccggttttacggtaaccgtactttcctctttctctttcccacttgtcagcgtcaacggtaattggcgagtagcgctaacctcgggtatctcgattcggaatacattatccccggacgccagtttctctttacggctttgctcgcctaaacggatcgtcactgtagaaggctctccttcatgtttcacggagatctcgaccttttgggtcagtccgtttttcgatttataaaccgccggcaatacacggctcttgatatctgataatcccggagacgcatgaaccgacaatgtcccgatcaacaaagccaatcctgctgataaataagtcctttttttcatcttatcgtgtttttattgatataagtcctatatacaacatacatattaataatagcatcaaaccggctacctgtccgaacctatcggctaagcctcccatacaaggcgtaatcaaggcgcctcctgacacccccataatcatcaaggctgagacctcgttggattgctccggccgatgttccaaggcgaaagagaacaggatcgaaaacacattcgaacaagccaagccaaccagtacgatcataacgcccatgctccacaagctatccgagataagcaatcctatgaaagcaaggatagcgataagcatgcttccccttaagaagggtcgtgacgagatcctcgccaacaatatagccccaaggaaagagcctcccgtacgagcggcaaaataaaggctactccctaatccggcctcttgcaacggcatggataacttttccatcaatagcttggggatcgtcgtattcagaccgacatcgatcccgacaatacacagaatccccaagaaaagcatccgtatcctagcatctttacataaagctaatgtagaggcgaatgaggcttcttgctcctctccttcctctttacccggaatagtcgctatcaaccagatgatagataacaaggtagtcaccgaatagacaatgaatatcaacttccaatccccccaaaaagaggaagcgacccccgcaataatcggacctaagaaggaagataccgccttaataaactgccctaacgtaagcacgctcgttaccttatccggatttaccacccgggctaccatcggattcaaagacacttgcaagatcgtatttccaattcccagcaaagcgaacgcaaacaagatacaagcaaagtcatagaagaaaagaggtatcagcatcgccaaggtcgtgatggccaaggcagcgactaccgtattcctacgcccgtgccgtcccatccagataccggtggggacagagaacagggcgaaccaaagaaagaccatcatgggtaataggttcgccaaggtgtcggacaaaccaaaatccatcttcacataattcgtggcaattcccacgacatccacgaatcccatcacaaaaaagccgaaaaggatcgggaatatagcggagttcgtacttttagttctcatatcgatcttttggttggctacccatttctaaaaccaaatgtccaccttgaataatctccgagaaaggaatacgagtatccgtcaatggtttcccgtttaagttcatcgattgcacgtaatcattttgcttactattattacgagtctcgatcacaaattccttccctttataatagcggtcattcagccggatcgtaatcttatcgaacaaaggactacccaaagcgaaagaaggcgcttgatccgtcaagcctttcatatcgaataagcctaaggaagagattacgtaccaagccccgagctggccttgatcctcatcttgtccgtagccataaccgtggatgccatccgtaccatagaactcattcaagatcgcccgcacccatttttgcgtaagcgagggacgaccggcctcgttgaacatccaagggatgtgcaagcacggttggtttccttggttatacaaggtttgcaaaccggcgaaagcccctacttccgtgcctccgctaaagattaatttacgagacaccgtgaagatgctatccagccgatggttaaacacgtctgcgcctactttcgcgaccaagcctttcgcgtcgtgcggtacatagaatgtatattgccaagcgttaccttcttggaatccacgccatacttgcatcggattgaagtcctcgataaacgtaccatccttctttttaggacggacaaaattacaggaagggtcatagatacgctcccagcctttcgataagtccatcaaacggttataatcgtccgtcttacccagttgcttcgcccattgggccacggcccacgcactataagcatattccaaggtatgggaagcggagaacatgaaagcctcgtccggcccgtcccccttatccaaatgaggcacataaccatattccacgaaataacgggtatcgatctttcctgcgcccaatggacgattctccccatccaactcattcttcaagcaagcctcataggccgtattcacatcgaaatcccgaatgctacattgataagcgccggcgataatcgtacttaataaattcgtaccaaccccggagacataacggctattagcgattccatccgccagccagccggcgtccttgtacaccaacaaatggctacttatataatccgaataatattccggataggccaaagcccaaacctgcgtcagattccattgcgctccccaagcggcatcggtattgtataagttatgtaccggttttccgtctttcaaagggatttgtcttaccgagccatcatttctcggataagcgccattcacatcgctagccaatccacgccccaataaagcgtgatacaaaccggtatagaatttcaccttatcctctcgcgctggagtctctacccggatacgtcccaaatattcttcccatgtttggcgagagatttcccttgcctcgtcaaacgtaagggtagcggcctcagtctccctatttaaccgggcattctccacggatgtataggaaagacctactttagcggttaccgactcttgatcttgggtacggaatgtcagataaagtccggcccccacgcccgtcgctttccgttcatccggacggatatccgccccgttgaaagcgccatatccaacgggagccttatccagcaccgccgagaaatacaaaggaaccgatgccccgggctggtatttcctcacatattcaggctcggtaatcacccagccctcgatacgcccgtcttccgtaaaagtaatttccgcgtcccgcacggctccgctttctccttggcggtttcctatatcgaacaagatacggctatcctccccggccggaaacgtataacgctggatagcgacacgaggggtagcggtaagctccgcccggatcgagtaatcttttaggagaacggaataataaccggcggtagcgatctcgtccgcacgatcaaaacgggaacggtatcctatacctgtcgagtcgtctaccgccccgggaattgttttcaatgaacccgtcgtaggcatcaagacgattccaccgatctgaaactcatgcaagcaggggaaaccctcgatcgattgatcccgataatcgtaaccggtagcctcccaaccggatttattcccgatatgcccgttcgtagaaggggccggcttggccataccgaaaggcatcgctcccggggtaaaatgaaaccaacggcaatgcgccgtgccgatccgaggctctacatattggctaagctcctcttgctggaccttcttgccttgtgtcacgcaggatgtgaaaaccccgcacaggaacaagaggaaacagaccggcttcatactatactttctcataatttatttagatagatggtttaacgcaaaaacataagcacccatagcgatcgagcggttggctccttgcttgctgaaggtcacccctatccgtttacaaggatcgtatcctaccttgcgattcgtacccgggactagcacctcgacagcctctccccgggcaaaaccggcgaagctcttctcgtcgtccaagtcatacacctccttttgcaagcgcccgaaacgagcaccgtccatcattcccgtctgcgcgttcatctctttcaacaaggccggcaggatgtacttggaagcaccggacaaaccaccgcctatcacgataagcccatcgatcaaggtaatagcggaagccaacgcgtccccagccatctcacccaactcctcaaacgcggcgatagccgcttcccggttacccggacgaataccctcggcgatctcgaagatctctttcggggtacgcgcccccgcatcaccgctccgctccgcatagacacgcatgaccgcccgtatgctgacgctctcctccacgatatactccgggtacttcttgttccgcaggcaccatacatatcctcccgccgcgttatcaccccgcaaaagctctccatcgatgacaaccccggcaccaaagcctgtccctagcgtgacacctagcaaattcttatatcgtttcgtacttcccgcctcccgcaaacggcggttgatctccgggagcactcccgtcaacgcctctccgtacgcgaacaagcttccgtcgttattgataaataccggtatcccgaatatatcttccagaaacgggcctaacgctacgccaccccggaaagaggggaagttgggtaaatcgcctataataccggcttgatagtctgccggaccgggaaaagcgaaactgatagcgaccggagtttccggcaagcctgcttgaattgccttaaaaccctctaccaaattgcctaaacacttatctaaacaatctgcgcatgccggaagaactaccggatcggctatctcttttccaccttggatggcagagaagacaaaattcgttcctcccgcatccaatgtcattactattctattgtcatttgtgtacatcatatattccttttctttacttaaagaggtcccgccagtgccacagcagtggcactactttgccattagaggtgacacaaccttgccttcgaagtggcacaatcgtgccatcagtagtggcaaagcagtgcaatgcctatggcaaacggtgattattgcctaaaacgtacgtaagcctttatagtaccacaatatttacctacagacgatccatacggacggatcgtatattcacccacgcaagccgggatgataaaagtctccgcgtaatgaacgatgaaaggttcgaatgcgcctgtcgggctctccacgatcaactcatctcccttgatcacgttcagcacttgcacccctccattcgtattgtgaggcacgatatccgtgaaccaatggcggcgggtctcgatgaactcgttctcgtgcaagccggtccgttcctctcgccatccgtctccctcggcgaccatctccacttggttgatcaagtggttacggacaaactccgtttgccgctcccattggatcactttcgaaccgtggccgatattaataggtcgaggcagtccgtccaatcccaagcggccccagtcccaaagcttaaacgtaaagatacttggcgtagcgctaatctcaagcaccatggcaccggctcccgaacaatggaccgttccggcgggaatcagataatgatcatggcgtttagcaggccatttattgacatatttctccgtatcgaaaggctttccggtctgttgggactcgtttagggcagcgatcatctcgtccggatttacaccggttttcaatcccagataaacggtagcgtcctcctcagcatccagcaggtagtagctctcgtcctgcgtataataaatcccgaacgtatcccggatatattgggtgaccggatgcacttgtaaacttaggtttcctcctcccatcgtatccaagaagtcgaaacggatcgggaaatcttgcccgaaacgagcctcgaccggcccgcccagcaagtctctcgtcttatagaataccaagtcattggaagggatctcaaacagctctccggcaactttcaggtataaactattttcctcgggcacgcaatcaaaacaccagccgaagttatcttgctttttatccagatcacagacctctttcatccattggccgccccaaggagccggatcgaagaaaggtactacccggaacggagtatgcgccgttttctccaacccttctttcaaggtctccccggaaatcatcttaggtgttccgacgatatgggtatccaaccaataatcgaccttgggaaggactttcttcttcagattatcgcaaacaatccaatcaataaaatatcctcgcttataatggtacgacggggcttcctcccggttttccacacctagcccgttcacctcttttctacgggaacgcatctgaatctcccaacgagccatgtctgcgtagatcaatttgtccggagcgggaacgatctcggcggcggcgtggccataaacgattgtccagccttttccatcacgcaaggactcccggcaggcgttcaccttctccgcatccaagaaatccgtataagagaaatgagcccggcggccaaacaaccggtcatccgtcagataaggataggtcatcgcctctatatcttctgccgatttaaataaatctcgcgtattgataaaacgatcgggcgcgagtgcttgcagttcacgcatcaactcctcgtgatgaaccccttggtagcattccaccacccaaacttgtgatccatttgtttccgcatgtatctccgccaatcgcttccgtatcgattcccagcctttccacaaggtaccgtctacaacggtggccggcattttatcataattactttttctcatctcttttgatatttaatattgcacgcttgtatttaactcttatttttctctgcccaatcccttaataattcaatcgccttagataacactccggccgaccccttgaaattaccagagccactggggacaccgcctttgccataccattcgtagaatccgtcattttggatcacacgctcgatcatcggatgaatctccgcataagcctcctcaaccattccattaacgacaagctgctggatcatccgaccgccaaaccaagtccaatccccgccattctgatacagataagcctttgacattcctccatggaaaaaaccatccggatacacgggatataaggtaagaccaatgcttggcatacccgacaggcgaacattctcaagcatctgggcatttacggtacgtatctcgtctttcgataataagccggcctctatagcgatagccgtcccaccatgataatgaatggcaagttcatcaaaaccttccggaatcggagatttctccggataaatatgaggaatgaacttctggcgctttacatcccatagatgagcccgcacatttctctcgattccctcacgcagacttttccaacgggaggcttgcggagaatcaggagccatttccaacaaataatccaaagcgattatgaacatagcgttatcatatacatcgatagccagatccgacaaatcattcatatcacatccgaaatcgtcattcggctgtacatcgccccaatcagcggtcattgctccataaagcaatccatatttctcattatatcgttcccgcatcagataatctaccatcgcgttcattcgctcgagaacggtcttcccggcaactttctcattcaatatctcccgatcacccgtcttacgaatgtatttacctacgatctgaatcaaggaagactcttggtccgtctctaccgtattcttaaaagcgacatgtttcggagcggcattcgaataataaggcgtatcatcataccatgtaaaatcttctttcagcacataaccatcgatcatctcatcattcggctgttgaagagcgaaaaacaataaaatagcttcccgcagttcgtgtggatcactctcctcgcaagcgatctctataaacgtattcatatcacgagcccatatctgggaataaccgctccctgcgttaaagccactacgaatggtcgcacgagccatactatccaccttatgtaaagccgtgtcggacaatatttgatcggccaatcgctgtttctcggtcaatcccgtacaggataaaaaagatacaaatacaaaagaagttacaactagaattttattcatggcattaaattatgatttatggcggcaaaattatttcaataattcagaaaggaatactacatttgttccgatttacttgtacaatcttatgatttatagattatggtcaagataaaagaaggatttaagggggaacggctcgtctctttgcccgaggaactattgacaagctatcaaagggaaccgctcatcaataatttatatgtacgtaagataggtttcttcccacgtgttaaatatcattttctccaaaaagaacatggctgtgactacgccatgcttatttattgtacggagggaaaaggatggtatcgtatcctcggtaaacaatataccgtggagaaataccaatatatcatcatccctcccggtatcccctactcattcggggcagacgagggagatccatggactatttactggttacacttccaagggaagctttgcgatcaattcctgccgtcgcatccggttccggtcactatttcgccgaatgaatattcccgtttacaagatcggttacggctgtttgaggagatatatagcagtttctccatgggatatattaaagaatatatgatttattcctccatgtgcctttacaattttctggcctctttcatctatctggagcaattccgccatatcatgattccctcgcaaaaagaatatccgttcacggcacgggttattcattatatgcgtgagaacatccagcagaatcttaccttgaaggaattagcgtcttatttcaaatattccccttctcacttctcggctctcttctttggcgagaccggggtctcgcccatgaattacttcatacgcttgaaaatacagaaggcttgtgaatatatcgagctaacgaatatgaagttgaatgagatcgccacgcatctgggattcgaggatgccgcctacttctcgcgtacgtttacgaaagttatgggttgctctccttccgtttatcgtaaaaaggagatggagatatagaattcgtttggatttctagtatttctcatgagaataaaatatatttgtacaatagatatttaaacgaacataaagtaagtagttactatgatagacctaacacagttcaccccttggactctctttacggatcttggattcatttcgatacttctattggttggcaaattcatacgagtcaaggtaaaactggtacaacaattattcatcccgcccagcttgatcgcgggcttgctaggactggcgttcggacctaatggactggggtggattccgctttccaatgatttaggtacttacgcggcgatccttatcgccttggtgttcggcgcgttgcctttatcttccccgaacgtatccatgaaagaagtggcaaaacgagtcggaccaatgtgggcgtacgctcaggtgggtatgttattgcaatgggcattagtaggcttgttcggattgtacgtgatcaagctgatctggccggacctgaatgacgctttcggcattatgctgccgacaggtttttatggcggacacggcacggccgccgctatcgggtccgcattcgagggattgggctgggacgaggctcgcagtttaggcatgactactgctaccgtaggggttatttgctcgatcatcggaggtttactgatggtcaaatgggcggccaagcataaacaaaccgcttttatctcggatttcgacgatctcccggacgagctgagaagtgggttgctgccagaggataagcgggattccatcggagaagctacgacttcctccatatccatcgatacgctgactttccatgtggctttggtatttgtcgtggcttttttgggatatatggttagccaaaccgtaaaggtgtattatccggtattggagttacctgttttcagttgtgcctttatcattggattagtattaaagaaattcttcgacgcgacaaccatatccagatatatctgtccacagacgacccagaggctgagcagttccttcacggatatgctggtagcttgcggtgtagcgtctatcaagctaggggtgatcgtaaaatatgccttgccgcttatcgtactcatcatagcgggcgtggcgatcgtctggtgcataacattcttcttaggaagaagattagccaagaccttttggttcgagcgcatgattttcgcttggggatggtggaccggcacgatggctatgggcatcgccttgctgcggatcgtcgatccgaaactttccagcaaagcgatggatgattacgcaatggcttacctgcctatcgctcccatagagatcttattgatcaccttcgtccccatccttttcgtaaacggattgggagtttggttgctattagcctgcttggtcctttccctactgatcttgctactggcgtggaagatgggatggtggattactcgctcttgatactatttaccgggttctcgttcgccgctttccagttctggaaactcacggtcaataacgtgattacggttacgatcaataaagcgattaagaatacccacccatggatcggagtcttgtaggcgaaaccctcgagccacatcctcacgccctgccaagcgatcggcgccgctatcacgaagcaaatacctacaatcctcagataggccttattaaacatcagcaggatctcccctaccgtagctccatgtaccttgcggatacctatttccttacggcgatattgagtctcgaacaccactaagccaaataccccgaccaaagagataataatcgccagcagactgaagaccgtcaccaagctgcgtaagttctcttccttccggtagagatgattgaagatctcatcatagaactcgatattgaacggataggaagggtctaattctctcatcgtctcctgaatgtgacctactacggcatgaatgtccgatccggctttcaagcggatataagagattggcaaagaataaccaaagtttccgaccaagaaagcgatattatcctctccaccacgaagcgaggtgaatttcacatcgtcggagaaaccgacaagatgaccggaagaatagctatcgaacgcgtcacccacttgcatatccaacccctccatcgccgtacgattgaatatataagacacatgatccgaaagctcgtccgcctttgagaaatctctcccttctataaccggaatccccatcacccgcaagaaattggaagatgctataattatgaaatactgaaagtccttacccttataattaccgccattcgtgttatacccgtccttagagcccactttctccatagcgaaagccacatcctcgatccccggattctctttcaagcgattcacatatgtatcgtgatgcttattgtacattgtctcattcagctccacgatagctacctgatccttatcgaatcctaaagagaaattcctcatataactattctggatttgcacaaagcaagccccaataatcaacacgatcgaaacaacgaactggacacaaatcaatgtcgtacgtaacttacgcccggaaggagataacccgaagctgcccttcagcaccaaggccggaggaaaagaagttatataataagcaggataaatacccgccagccaaccgataaccaacgctacgatgccacacaagaaaacgatcggaagatttgagaccaaactcaaatcggcctcgataaaaggtagcgcttccgcccaatccaatccccaaacgataacgagacttaccagccacgccataaaactaataagggctgcctctatcaataaagatctgcgcaacaaagtatccgagctacccaataccttctgcgtattgatgcttttgattcgcaacggagtcaaagaagtgctaaagttcgtgaagttaatagccgcgacaatgacgatcagaagggctataccgaacaataaggccgtgacttccttgtttccgctccggaatgtaccaccgtcttgcgtctcattcatataataaatatcagtcagcggaacgagccggatctgttctccttcatggtaaatcttcttgaaatcaaaatgacggttgaaattatcggcaacctcatctgccatggcaggattatcaagcaataaataacaaacccagttacttgagctaaaattattgatattataatccggatcgatcgccgtatagaccacgttccgaagctgcgtgttctccgggaaatccttataaaccgcgccaatcgtaaagagcttagccgatttagtccagatattttcttccgctcgcaacgtcttaccaaccgcagagatatcttccccaaacaacttgtcagccaagcttcggggtaccattactttctcgggatctttcaagcaatcgatatcgccttccacgatcgggaacgcgaatatcttcggtaaactagcgtggcaggttgtcacgatttccttaaacccaaacggttgcccgtttctatccaccgagagataaacaccattctggccaaaagaaggagtcaacaatgtacccgcctctatatgcggggaagattggatgacagcctccacaaaggcacggggtaatattgtcccgaaagtacccggaatggtcaagtccaccctaaaaatccgcccggacgtaggatggcaacggtcaaaagtccgctcaaaattaatctgtatcaaaatcacgataaaagcggcgaaagcaaccgcaagaccggctacgttcaatgcggtcgccattttaaaccgcctcaacacacttagaaagtttcgaataatcgttttcattttattatagtttcatttattattccgttttaatactatccaccggattcgcattcgccgcacgccagttttggaaagttaccgtaaacatcgttattaaggagacaattaatagagcgaatgcaaatatccaccaataaataggagttttataagcaaaaccctctaaccatttccgtacgccataataagccaaaggagccgctatgataaagcaaacgcagacaatacggaaataaatcttattgaacataaccaagatctcatgaaccgtggccccgaataccttacgaataccgatctctttccggcgatactgggtctcgaatataacgaggccgaatataccgacaatagagataatcacagccaacaagctaaacaataaaatcatcgtacttaaattccgttcttgatgatataaatgatcgaaaatctcatcataaaattccacctcacaaggatatgtgggatctaagtgggctactgtcttacggatatgatccaccacgcccatgatatcgcttcccgctttcacacgaataaaagaataaagcatcaaacgaggttcattaataacaaaacctaattcggagacgctttgtcgcaaggaagtaaatttaacatcatctataaatccgatgacggaaccatcggccgattcctcctcaagccatggaatccgcatgatatcattcggttccatgttccatttatcccgcatttgtctattgaatacataactatagttgttacctctctcatcagactcggtaggcatccgccccccaatcaatggaatacccattactttgaagaaattccaagaaacagaaagagaagtgaaattaacactctgctctttatatacacctccccacgtacgatagctatcctccgatccaaacttctgggaacagaacgccacatcctctattcccggatattctttcaatccacccacgtagctatccttatggtcatgcataatattccggttcagctcgacaactactacctgatctttgtcgaaacccaaagaatatttttgcataaacctattttgttgacgaacgaacatggctgatataatcaatacgatagaaacgataaactgaaaaccgatcaatgccgtacgcaacttcttcccagaggaagaaagcccgaaagagcctttcaatactaatgccggagggaaagaagtcatatataaagatggatagatccccgcaataagacctattataacagataatacagctaagccacctactaaaccggggtaagcagtcaatgtcgtatccgcttgcacaaaatacagccatcccatatgtcctaatccccaaacgataaacaaagaacaaaggaaagcaagcaaactaatacccacggcttcaaataacagggaagcacgtaatatgccagcagaactccccagaactttttgcgtgttgatactcttgatgcgcaaaggcgccaaagaggtactaaaattcgtgaagttgatacccgccacaataatcaccagaaaagcgatcagcatcagtaaccgggctttctccgcgctaccgcttttcactaaacttccgctggaatcctcgttcatataataaatatcggttagggggaccagctcggcatgtatatctttcgccatatccccatattgcttcgaatagtcaaaatgggcatcaaaattctcagctacttctttcggggaggcagaaggatctagcatcacgtaacagaaatagttactacttatccaattcgtcagtgcgtaatccggagacatctctgtataaatcacgtttttcaactgtgtattttccgggaaatccttataaacacctcctacgaccaaatatttcacgcccggtttcgtccagatcccaccatcgggaacgatctgctttccaattgccgattcctttccaaataatcggtgagccatactttcgggcatcaaggctttttccggttccgacaagcaagaagattctccttcacacatcgtaaactgaaacatccgggtaatctccggatggcaagttatgatcgtctccttaaaaccttgctttccttcttttcttgtaacagtcacatacatctctcctatatacggattgattaacgtaccagcctcaatatgcggggaagagtggataaacgcctctatcaacggtcggcaatggatcatgcttgctccatccgggaaagaaagtcccatccgataaatccgggtcgagttcggatgacaacgatcgaagttatgctcaaagcttacttgcaccatgataattaaaaacgcagcgaaagcgaccgctaatcccgctacattcaaaaaggtagctaccttgaaacgtattaatacattgatgaaattgtgtatgattgttttcataacttgctctattttattgatactaaaatcgacccaaaaagagtattccttaaataagatggctgatattcattcgtttcaagatattcaaagaaaccttgttcaacgcaattgtctcaacctcttccgtacggaaaaacttacttaaaccttcgatcttaatcatggctgtatttgttttaatttattatactcaaatccatctaataatattcaaataacgtgccaaactacatatcaaactaatattcaataaattaattctcaattcataaaacagaagtgtccaataattggacaccattgtacaattattggacacatacttttctatgaaaacagcaatatgattctacaaaaatcttctactcattcttaatactatgtactggattctcattcgccgcacgccagttctggaaagtgacagtcaatatcgtgataaccgctatgatagcaaaagcgatcaaatacacccaccaatacataggagtcttataagcgaaattctcaagccatcgatgtaccacataaccggcgataggcgcccccaaaacaaaacaaacacataagattcgtatgtatgtcttgttaaacatcacgataatctcctcggtagtagagcctaataccttacggataccgatctctttcttccggtactcactatcgaatacgaccaaaccgaatacccctaccaccgagataaagatcgcgattaaactaaataaggtaatcaatgaactgaggcttctctctttctcataaagtccgttcaatacctcatcgaagaaacggacattaaacgggtattccggatcaaatgattgaagcgtagtcttgacatgttgcatagccccccgtaagtcagagccggcttttacctttatataagcgtaattaggttggtttccccaattattagtaccccatacaaaaaaggccataggcgttacctccgtacggaaagaggcgaatttaacatccggcataaaaccgacaatctccatactatctattaaagatcctatctccagcccatattctgtccgggcacgttcgttaaagacaaacgtgccataacgtttcgccttatcttcctcccggaaatcacgaccttccgatattttcacattcatcaccttcaaaaaagaaggttcaaccggtagacattggaattgtatatccttatcccggtatttacgtccccatcccatgtattggtcctgactagaaaggagcatctccgcatatgtaacctcttcgataccggagaaagatttcacttggctggcgaaggcatcccgacttttccggatattgttattcatattcgtaataattatctcatccttatcataaccgagaggggtattttgcatataataattctgcaaatacatgaatgtagcaccaataattaatccgaaagaagctacatactgcactcctatcaatgcatttcgtaattgacgttccttcggagacaagccaaaactacctttcaacactaaagccggtgggaaagaagtcatataatatgctggatatataccggcaagaagcccggtagctattgagataaaagctgtagccaaaaccaatccgatatgcattgataacgaaatatcggcatttatcaatgaggctatttccgtcttccccgcgatataaactaatagcagtcctaacaaataagagattatacttattaacaccgcttctaaaatcaaagcaaaacggatcacagattcttttccccctaatactttttgtgtattaatactcttaatacgcatcggggtaagtgccgtactgaaattcgtgaaattaattccggcgattatcacgatcacgatagctatggcaaataatatcatcaaagtttgcctgctggctttcggggtctggtcatattttacatcagtcgtataatgaacatcaggcaacggattaatacggaaagtcattccagatcccccccatgagaaactattatcctttattagagcaggatcaaaatgtgccttgaaattttcaaataaccctcgacattcttcggattgtccaaacggatatagaaaatataattccagtttccccagctttgggcgttttccttcgggtccatcttttgataaatacaattccgtacagatgaattccgtggataatccttatacactccacctaccgttagatgatctccattctcaaacttcaattgcttgcctacagccgattgattcccaaaaaacttctgagccatgctctgcggcaacaaaacaacgtttggctcctgtaacgcctccggatttccttcctgaaatttaaagtcaaataccttcgtgaattcaggataaacatttatacattgttccttaaaagtattccgtacaccattctcttctacagagaaaaacaagtcccctccccaaggattcgccaaggtcccagctacgatatgaggcgaggattggataaaagcatcggccagcggacggcaaataactgcctgcccaccatcctcaaacatagcttctacccgaaatatagattccgtatccgtatatcctcggtcaaaattctgatcatactcgacttgcatcataatcaagatgaaagcagaaaaagccacagatagtcctaatacatttaaaagtgtcgccatcttgaaacggcgcaatacactcaagagattcctcaaaatagttttcatacgtaattttatattacctgttatattattcgttcttaatgctacggaccggattctcattggcgatattccaagatttcaggatcacgcatccccaaatgatcgctagaaccagtagagccgtagatatgaaaataaaaacagtcagcggtatcttatccgcgaattgcctcaaccagctctctcccacgactcgtgaggctatcactcccaaaaggatagccgggaaagccgtgatcaaaacatccttagataaaagacgtaaaatattcggggccgtcgctccattcaccttgcgaatcgctatctccttgctcctacggtgcatctcgtccgtaatataccctaataatcccattaaggtgatcagcaagatagcgatcgaggcaacaaagacgccgtcacggaaatgacgggttccctcatactgagactctatgatcgttttcagcaccgtaaaaccgacatcctcattcggaaatagttccgctatcttatcattcatttcccgtaaatattccggagttagctcggagacacgaaccgtaaagttacaataactcatccggtcactaccaaacatgatgaccggtaactggggagtgaagaaggaattcaccatgaaatcacgggttacacccactatttttccttttaaattaccctcatcatcataaatatatttaccgatcgcagcatccgtccacccacgtttactcacgaatgactcattcactaaaatatccccgtcaccttttagtggttgcccctcaagcaaggggattttcatcagagagagataatcggcatcatagtttacctgtcgggccgtgaacagccagtttttctcattatccagaatagggaaaccaccataaccacttagaatgtccattgacgaaagccccgtagccgtgacataaggtaacttcttgaactcggcggtaagtttggccgctttctgatcatccatattattcaagggggcatacactatattttccggatcatatcctaaatcattattcattagccgatcatattgcaataacacgatcaccaataatgtaatgacaaacgcaattcccccaaactggataaagagcaaactccgcttccatccctgcttacccgaagtagatacccggaatacttgggtaaccgggataacgctgaacaaacgggccggtagcaaggcggacaaaatgaatatagccaagatcatgatcgcaggaagccatatagtctgcgcattcaataaagtgcccaaagtaggaacagccaccatatccgcaacatattcccggaaagcgaataaaagcaatgccatacatacaagagccactacaaataaagccgccgtctcaaacaagaacatattgaaaatgtccttgctggaagctccattacatttgtgtactcctacggatctcgcccggatcggcagagaagataccgagttcaagatataattcatcgccgccacgaataacaaagcgaaagccagtacactcatgatcaccaccatccgcttcacctcggtactttgcgtatatatctccgagaccggcttgatataaagctccatatcaaaaccttgtttcctctctctttctacatctatatatttaggcaataaagccggtattttctgattgatttgttccgggaacacacccggtttcaggcggatatagcccagataactatcgtcggcaccccaaccggcataggcaccgaactgggttttcatattaatgaaagaagcgacagcgtcaaaacgtaaatgactattttccggtatgtcacggaatatcccggccaccgtataaggatagttttttccgtacagcagttgtttcccgatcggatcttccttgccaaatatacgttcagccattttttccgataagaaaacttgatcttcgattcccaacaaacggtcatcccctcttagcaccttgattcccatcgtacggaaaaagagggaatccgccatcatcaaacggggcttgaaccgatcctcaccatgatacaatacggctccgtatcttctccggcaaaccgtcgcatactgtatctcggggaactcttgccgcaaagcctccgggatcggggcaaataggatacgagacccatcttcctctcccgttttatcatcattgtatcgcacatgcacgctatacaaatcttccacttggtcaaagaatgtatcgaagctcaattcaaaagcgaccctagcgaacaggatcaatcccactccaagtcctagtgtcaaggacagaaccttgatcacatttccccctcggcctcgaagtaaataacggattgtataatatagctgtctcatcgatttgtatttaagttaaattgaaagctaaccgaccttcacaggccaattagcttataaaaaactcttgtgtgtatgtgtttatgtcatgttgactaaataaattcactaacggaagaaacaacgctaccgtcgaataaattgatcacacggtgggcgaaacccgcgtcgtgcttggagtgcgtcaccattacgattgtcgttccctccttattcagctcggtgagcagctgcataacctcggcaccgttcttggaatccaagttacccgttggctcatcggccaagattatcttcgggttggaaactaccgcacgagcgatcgccacacgctgctgctgacctccggagagttgctgagggaagtgagccgcacggtggctgatattcatccgcttcaagatatccgttaccatctgcttacgctccgacgccttgatctttagataagtcaacggcagctccacgttctcaaaaacgttcaactcgtctatcaagttgaagctctggaacacgaaaccgatgtttcccttacggacctgcgtacgctctttctctttcaagtgtcctacctcttggtcgcccaagtaataatttccctcggaaggattatccagcaaacccagaatattcaacaacgtagacttaccgcaaccggaaggtcccatgacagcgacgaactcgccatcttttacctccaaagaaaccttattcaacgcaattgtctcaacctcttccgtacggaaaaacttacttaaaccttcgatcttaatcatgactgtatttgttttaattgttatctaactatttaatttaccatatctaattcaaatagtgtgccaaaccaactaaatatttaattctcaaacaagtagtattttactttccaaaacagactgtccaattatttgacagtggtgtacaaaatttagacactactatccaatatctcgacataaagaaacacctcccagcttcacagatgagaggtgctattgttgacttatctacatagtaaaacctacatgtcactacttgatcttatctctatatctttttcctccggcatgtcgaagttctcaatgactgtcaagaaaagctcttccttatcaacatttatagaataagaaactgtatttttacccttcgagaaacggataaaccaactaaccaccccatcgttctcattctcgatcacttgataagcctcttccttgtcccgctcaaaagcggatttaatttcttgttgtaatgcggcgtggccctccacgacgaaagaagagactatcttatatacctttttagttttcggatctttattcgttactacgcttttatcgatcgtcttatccgctttacatttctgcacgacagcctccaaattcttctgtgcccataactctgtactgaaacttcccaccaaaaggcataatgccacccaaaaacatttacttgctttcataacttcttttgtttattagttaatttactatttatccaattccaatatcttataaacctccttacgtacctgagtatccggaatattcctcagtagagtctcccgtttcttctcgaaccgcttattcatcctttccggcaaataagctatttcatccgcatttcttaagagccgatccgcattcttctccatcgcttccgccgctcgggatatgacctccaattcgggttgtatcttctttatatctgtcattacgacaccattgcgcacgatgtagcttccctcataagggttaaaagaagcattttgattcataaagaccgtattcaccaaaaacaacaaaagagaagccgccacgcaaactgcgattgcccatcctatttttcgtttataagaaatttccttagcgggtagcctcaattccggagtctcgctaaaatccaaggcaatgccactctcgaaatatccgaatacctcccgataacgttccagatgggcgggaatatccggacgggcgaagaactcatacaacactcgctcctcctcgttcgaggtctgaccctcgaagaagcggtctaataaatcctctatagacttgtattcctctgttttcataacgtctgcattttaaagaattgatctctcacccgtttacgggcacgggaaagattcatacgtaccgcctcgggggtacttccggtcaacccggcgatttcctctacctcgaaaccatccacgtgtttcatgcgaagaatggtctgttgaagtcccggtagtttattgataagccgcattacatgctccaaactatctttttgttccagctgggtataaggcgtggaggcatcgcagataaagaattgttcgcccgcctcaccttccgtgcgttcacgaactttcatccgattcaggcaaaggtgctttgtgatttgtacggacaaggccattacattattataatagtctaactcgccacgcatataccatagtttcaaaaagacttcctgcatgatatcctcggcatcctccgggttatcaagcagccttctcgcataaaggaatagtttctcccgcaaaggcaatatctcttttttaaactgttcttgttccattctatcttaatgacaatcgagaaaagaaaacgtaacatggctggagaaaataaattcaaggtctttgtcattctagtattatagtcgtgccacccttatggcacgataatgccacggcgatggcacgatgatgccatagcgatggcacaacgatgccacgctggtggcacagccgtgccactataacggcacgggcttggcactgtaagttattactaaatagccctatacatcacagatacggatacacttctccaaggaagcgatcttgtcttcttgggcggggacgaactcctgcccaacgaagcctttatagcctgtctccataagagccttgatgatagccggataataaagttcctgcgtctcgtcgatttccgcacgtcccggactacctccggtatggacatgggagaagtattgattatatttccggatattctcgatgatattcccctccatgatctgcatatgataaatatcatatagtaacttaaaattaggggaaccgatacggcgacaaagctccgccccccaaaccgtatgatcgcacagataatccttatggccgacactgttcaaaagctccatggtcaagacgaccttgtgtttctccgctaacgggataaggcgcttcaaccccttctcgcagttctcccagccttgcaagtccgttacgccattacgtctgccggagaagcaaatcaagtttgtcaatccagcgtccgccaccatcgggatcaccttctcataactggcgaccaactcgtcatgcaaggccggatcattgaaacctcgatctattccaagcccggccccttgcgccatcgccaccgtcaggccatgtttttgtacgatcggccaatctaccgggtccagcaactcgacggattcaatccctatatgcttgcagatctcacagaactcgtccagcttataatcgccgaaacaccatttacttacggagtggcggacatttcctttcaagggtcccctcgcgtctgcttcctttttagcggcggctaccgcctcgatacctgtagtcgccaaagccacgcctccggccagaaatgtcttgatagccgttcttcttgatatgttttccatgtattcgaatttgatcgttaataggagacaaatatacggaaaatcggatataatatcccaagacgttggtattacatccaaaaacactacttttgcatacggaagtcactctagatgaaaaacacatcatatacaaaacgatctatttatctgatcctattctttataataggatgcacttcatccctatacggaatggaaggcgcaggtgtgtatttcaaggcgagcctatgcggaaaaatctataagcatttatcctttcttgtagaagaggacatccgtccgagagatgacttcaaggaagcggaatggttcctcaccaccgttgaggtaaactacaagtttaataaatatcttctggcaggaagcggatatatgtctctagcgcgatacaaggcatccgatgagttgcgaaaccgatattatctctacgctacggggacttattcggccggacgttttaccctctctgtccgggaacgttttcaaagtacctataaggttcacgccgaacatcccaagaattatctgcgttcgatgctgaccctctcctataagatcggcaagagtggtttctgtccttttgcctacaccgaggtcttcaatgatacgcgaaataagatgcggtccgataagatccgtttctccacaggaagtaattaccaactaaacccgaacaataacctccaactctattatcgctaccatatatttaatgtagacgatcccgtgaattaccgccatgcgatcggtatctgctatacccatcgtttttaataagaattttcgtacctttgcgtcccgagtgcttgataaacctcgttaaaaacaagaagacatgcaaaaaacagttacagtacctttcatgctgctaggtatactttttaatatatgccttgtagcgtccaatcttttagagacaaaagtagtgcaagtaggcggtataacggctaccgcaggtttgatcgtattcccgatctcgtatatcatcaatgattgtatagcggaagtgtggggattcaagaaggcacggctaattatctggagtggcttcgcctctaattttctggtgatcgcattcgcgcaattggcggtattattaccggccgcccctttttgggagggtgaggaaggtttcaatttcgtcttcgggatggccccacgtatagcggtcgccagcttgatagcgtttttggccggttctttcctgaacgcctatgtgatgagcaaaatgaaaatcgcctccaacggaaagaatttctcgttacgagcgatcgtatctacccttatcggtgagagcgccgattccctgatctttttcccgatcgccttcgccggattgatcccggccggagaattgcttatcatgatcgggacgcaggcggtacttaaatccttgtacgaggttatcatccttcccgtcaccatccgtgtcgtaaagtacatcaagaaagtagatgggaatgatgtgtatgatcttggtacctcgtataatatcctaaaggttaaagacatttaggccgggaccaaacaatgaccggccttcatttgaatagatgcgaccaatcctccctttgctgcggcatataggacttcattcccaataattcagccgcccggcaattcacggaagcgtcatcaatcagcatagtctcctcggctaaaagattcgagtccttcagtacgtactcaaaaatatctgcgttcggcttcagcatatgcaattcgtaagagaggtaaatcttatggaagaaatcttgggcacaaagaccttgataagagaaataggtatcttcggaccatttccaatgaagctcgttcgtattgctcagaagcatcgtattatagcgttcacgaagctccaatagcagacgcaacttattttccgggacgtctcccaacatggcgatccatgccgtgtcgatttgttcgtccgtcaggggctttcccgataaggcacgaatatcatcgcgaaactgttccaccgaaatcgttcccaactctaatcgctcaaacaagtccttatgttgatagttattcgtgatctgttcccggatattctccacgcccagattctcgaaagcctcgatacaacggttgcgagtcaggttaataagcacaccgcccaagtctataatcaagttctttatgccttccatatcatttctttttataccagctacgacgtctgcgatgtcgtcttttctgttgataacgattgatccgcttgtaaacgacccagacaaacaacaagccgaaaacagcgaatatcaatataacaatccaagagttaagattgtcaccttttacccggctccacatttccagaaccacctccgtctcgttcccgaaatcacggatcatggcacaacgttccacgaccttccggtccggatattgagccgggtctatctggacacgctccgctcccggtccgaagaaataacttacgtccgagaactcggtccgcgtcgtatcgatcttttccgccaatatttccggggtggccacggtgctgacatatccggtcacttccatattacggctgacgatgtccggacggcatagatagtccataaaataactggccgccttcacgttgcgagcgtatttagggatcgcccaaccatcgtaccagatattactaccctccaaaggaacctcataccccagatctacgcctacagcactcgcctcttccatggcccagaccgcgtcgccgctccaagtgaaattcagccacgcctttcctttcgtcatcatctccttaccgaaatcggcctcccaaccggcgatattcggtttcattttctttaagtattcctcggcgatagcgatcatttccggggagctatcgttcatcaattgctccaccgtgatggtaccgtccgccaattccctcgcatgggcgtagatgatggcggttccataagcgtcacgatagctatccttcatcaagatcttattcctgaaacgagggtcccaaaggcatttccacgacatgacctcgtccctcgagacatcggctttattatacaacaggccggcggttccccacatataaggaaccacgtagtcggtagtcttacggcccggctgacttaacttattcagttcctcttggatatagggagagacattgtcgatataatccggtgtcttcccgaaattacggtcgatcggtagcaagagatttttccgcagcatgcgctcaaggatatactccgaagggcaaatcaagtcgaaatcctcatgtccccgctcgatcttggtcaacatgatctcgttgatatcaaagatctgatagataatccggacttcctcacccgtctgttccttataccatttcgggaaatccgtcaggacgtcctcgtcgatataatctccccagttataaatcttcaagatcttgcttctctcctcgtccgagcgcccgcaagaagtgaacagccccataagcagggccaaaacagacagaatcgatataaatttcttcattttcatttacgctcgcttcgctttctcagcacgtttatttataacaatcaacaatactaacacggttacgaatataatcgttgagaggggacgcagttccggggtcaaacctcctttccgggcatccgcgtagataaaggtggaaagggtttccaagccctcattaccaattgtaaatatggtcacggcgaaatcgtcgatagatagcgtgaaggcaaggataaagccactgatcatacccggacggatttccgggaagatcaccttccgcaaggcctgaaacggagtcgcccccaaatccaacgccgcctcgtagatattctggttcatttgtttcaagcggggcatgacgcttaataccacatacggcgtacagaacgtgatatgcgccagcacgaccgtcgtcaaaccttgagagatccctaagctgacaaacaacaggaacaaggaaataccggtaatgatatccggattcaacatcgggatgttattgacaaaactcacggcattgcgggcccttgccttcaaattaaagatcccgatagcggctacgctccccaacaaggtagataccgtagcggctatcatggcgatagcgaacgtattccaaagtgcgctgaccaacgaatgttgtacgttgccggcaaaaagagagctatataatttcgtggagaacccggtccagttacccagtactttcgcctccgtgaacgagaagatcatgataatcaagatcggcgagtagagcaacaagagcaaagcccacagatatcccttagctaaatatttcaccatcagataagccctccctcattcgccgaatcactgctctcattgctgaacaatcccgtgattccgattaataacaacatgataagagaaagcgccgccccgtagttccacataccgttattgatattctcctgtatggtcgtaccgaagagcttgatattgttcatcgtcaacaactcggcgatggcaaacgtagagatggtcggcataaacaccatcatgataccgctcatcactcccggcatcgatagtgggaatacggccttgataaatacctgcgacggattcgcccccaagtcttgcgccgcctctatcaagctgtgatccattttctggagcgtattataaatcgggtagatcataaagggcaagaagttgtacaccatgccaaagatcaaggccccctctcccagcgggaaattcaagaaatcgaacaaagccacggtagccaacgtacggatcaagatattgacccacatcggaaggataaacaaaacgaccatcgtacgggaagtattaaatcgggcttggctcaatatccaagcggccggatatcccagcagcagacaaagaatggtcgttatcaaagcgatcccgactgaatacacgaaggtgtttatcgcctcgggatggatcatgaacttacggaaattggcgaaggtaaacatcccctcgtcattcgtgaaggcgtaatacacgatcaagaagagcggtatcacgacaaagatggccaagaacaggacataaggaatggtccagttccttcgtctcataaaaaatgcagaaaacgtattgatcacttccttccctttttaagcatgaataattcgaattttatccggggcgatcgttatgccgacatgatctccatcatcccatacatcgttggtatcgacaaagatgtcctcgtcccaatctgtaaacacggtcagatgataatggttgcctttgtagaggataaatttcacctctccggtcaggcgaccgtcttcctcgttatcctccaagatcacatctttaaaatcgatctcgactttcacaggcgtatttggctctatatcggttacttccttacattcgaacgtacagcctaggaattccacatgcgtagcgtcgataagctttccctcgaaggtattgcaaatacgctctttcttcattacatggatatcgaaaggcttgataagaagcccgacctcgctacctgcctcgaaacagtggtaatcctgtaccatgaactcgtatccgttcggggtttgcaccatcatctcataatgcacacccttaaagatggaggaggttaccgtacccgtcaacatcgccgcctccgacggctcgaagatgtaaatatcctcggggcgcaacacgacatctaccggcatttgctccccgaatccctcatccacgcactcgaactcatgaccggcgaaagagacttgccaatccttgatcatcgtcccgttcaagatgttactctcaccgatgaaatcagcgacgaacgaattgaccggctcgttataaatatcgatcggggtaccgatttgctggatctttccctcgctcatgacaacgatcgtgtcgctcagcgtcagcgcttcctcttggtcgtgggtcacgtacacgaacgtaatgcctaaggacttatgcatctctttcaattccatttgcatatccttgcgcatcttcaagtccaaggccgccaacggctcatccagcaataacacctccggctcattcacgatagcgcgagcgatcgccacccgttgctgctggccaccggaaagggaatcgacatcccgatcctcatagtctgtcaaccctaccattttcaacgcctgtttcactttcttctcgatcgtggcggaaggaagtttcttcagcttcaggccaaaggcgatattattgtacacattcagatgtggaaataaagcatatttctggaataccgtatttacgggacgtttatgcggcggcgtctgcgtaatctccttcccggacatcgtgataacgccctcggaggccgtctggaagccggctatcaaacgcaacagggtagtctttccgcaaccggaaggccccaaaatggttacaaactcgcccttgcggacctgtaaatttacatcattcagcacggccttctcgccgaaatacttcgatacgtgctccacgctgataatgcgatccgattttcgtattgacattctcgcttgatctaattagaattaaacaatcatgaacaatgttcttatttatttttgcgcgaatgtacagattttaataaggccgggcactatcgtttttacaaaatctgaccttacaccgggtgagaagcgtcgcatttctctaagattcgaccgcacacccgatgtaagccccatatttctccaagattcgaccgcacacccgacgcgagccccgtatttttccaagattcgaccgcgcacccggcgcgaggtcccgcatttctccaagattcgaccgcacacccgacgcgggcgggatatttgggaaatattcaatccacgtatatccggtagctccccgatcccaatcggtacacagccttcccatccttcaatcccacgggcgtgatcccctcctgccctttctccatacgaacggacttctccgatttggcgggcagatataaggtagccgtcgtattagcgggaatggttgcctcgtatatatagcccttcttttggatttgccatccactctcgatacggccataggcggaatcgtaatgaccccggatgaacgagaaggttccgccgatacggggttgaaggatgatgtgcttataggcgggttgttcctcatcccgctggatacccaaggtataagctatcatccactcctcgatagcgccatacgaataatggttgaaagagttcatatccacagggccgaagccatttaccaacgtgtaggaattccaacgttcccaaatcgtggttgcgccttgcaggacagggtatagccatgaaggataggcggtttgctcaaataatttataggcgacatcgtcataaccattgtcggataataccaaattcaggtaaggcgtaccgataaagccagtggtaagcgtataattatgtttcttgatattctctaccagatgccggatcgccaagggtttgtttttctcattgaacagatcgaactggagaggaaccacgtatgaggtctgcgtatccacgatcttcgcctcggtagccgccgttccgggccacatacctacttgcgaatccttgccaaagatagattccaccgtcggggcgaacgtgcgtccttcctcgtttacgaacaggtcgttaaaagacctcttcacgttctcgtagaaagtacggaaacgcctttggtccgcatccttccctaaacgtttcgctacctgctccataatcaaagcgtcgtaggcggagtaagcggtgttcgtcaacatggaattcgtcggctcgatagccagccaatcaccgaaaccaccgaagggctgtacatagcgtacggcacgacgctccaaataatccatataagcgaccatggaagcgtaatgttgctccagaatacgcacgtctccgtattgttgatacatttgccacggtacgatcacgccggcttccatccatcccatggcacctccgccatcctccgcgccgtgaggcgggaaaccgaccacgggtatatagttcgcgtaactaccgtcatctccttgattatcccggaccgagtagagccaacgggtgtaaaacggatcgacattcatattataagtagccgtacgagcgaatacctgcgcatcccctgtccagcccatacgctcatcccgttgcggacaatcggtcggaaccgacaggaaattaccccgttggccccaaatgatgttattaaacaaacggttgacacgctcgtccgatgtctcataaccgctcgtccgcacaccgatagattccagcacgatccctttcaccgcctccaagggtaacggcctctccaacccgtgaatctccacgtaacggaaaccatggaacgtaaagcgaggctcatacgtctcacccgccgcatcccctctcaggatatagcgatccgtggaaagggcgctccggtaattatccgtatagacttgccctttcttctccttatacatcgcgatcgtgtacggggcgaccagctcggtagggatcgtttccggataattcatctccccgaaacggatcgtgatttcctgtccggcctttcccttgaaagtcagacggggaacaccgaccatattctgccccatatcatagacatagacgccgggaataggctctaccatggactgagcggtcagggtcacattattttgtatcgggctgcctacatatccttggatctccacatttaccggaggagcggcgaataaggtcgccggtttccatgacgagtcatcaaaacccggagcatcccagccgttcacctctttccgggcatcatattcctctccattctgaaggccgttaaaagtgatcggtccccggtcataacatttccagctatcattcgtaacgatcgtctcacgagtaccgtcggcatactcgatcacgatctttcccaataaggactggcgggttccgtattgatcctgccaaccggtaaggaaaccgctatgctcgctccaccatccggcgcccaacatcgccccgataccattatcgcccggtcgtagcaaatccgttatatcatacgtattatacatgatacggtaacggtaatccgtccaacccggattcagataatcctttccaaccttctgcccgttcaccgagaactcgtagacacccctagcggtagcatataaacgggcgctcttgaccgatttctctatctttatcgctttccggagcatgggagcggatacgttctcgcccggataccagacattgagctttccctcccctttctccacataagtctcggcaggatcgtacagaagcgtattccacgtatcctcgctgatacacaagttggagaatgtagcggtctgccctttaggttgcaggaaaccgatcgcgtacaaacggcaatgataaaccaactctccatccggataaggatacacggtgaaagccccttccttgcctccccagaaatcaccacggctcttccgttctttctcctcgggagtcaaagaggaattcaccaaggtctttccatcgatctctatatccacgaaatatttcaaggcatattgggccgtcgtcaccttcaaccggatatgatgcgccttatgcttatccgaggctgggatgatggaggccagactctccgaggcgtcttgcgtcgtttttccatccgtggtatggcgtagaatgaaacgggcgtcccccgaaccattcaagtccagttcagcagacacataattatcagcgtccctcgccccaaagacaaatgcggctttatcattaccctcggccacccgcacatcatagtcgatcacataatgcgagcgatatttggagagttgtgtctccgacgagccgatccaacgggcgccactccatccggaacccagaagaccggtctcgaaccacgcaggctcggtggaggtaatttccgttcccgattcatcccatacggaaactttccaataatagcgagtggaaggttgtaatgcttttccttgataaactacgccgaccgattccccggaaagaacctttcccgaatcatagatataacgcccggcagccaattgctccggactatcggccacccataaccgataagcctgcccacaggccccatagcgatcggactccatctgccagttaaaacgtggctgactgacatcaattcccagtggattggtttgatactcaacctgtaggttcttcaatacggtaaccgcacccagaggtagccatccggccagcaaccctaagattatagacaaaatacatcgtgtgctcttcataatacaaagaattaaaatgataacggtacaaaaatatccattatcatcttaactctttgtttcatttttgggagaagatgtagcagttttgacactactcaatctttcctaccatcttggacgggtctacccaacgatcaaactcctcggcggtcacataaccggactcgatagccgcctcccgcaaagtcttattttcttgataggctttctgggcgatagcggcggccttgtaatatcctattttcggattcaaggcggtaaccagcattaaggagctatccagatggcgtttgatgttttcgttcaccggggtaatgccttttacgcaatgttcgctgaaattcaggcaaccgtcaccgatcaagcgggcgctttgcaagaagttcgagataatcaccggcttaaatacgttcaactcgaactgcccgttggagccggctatcgagattgtcacgtcgttacccattacttgagcggcgatcatcgtcaatgactcgcattgcgtaggattcacctttcccggcatgatggaggaacccggctcgttctccggcaaatggatctcaccgataccggcacgaggacctgagcccaacattcgtatatcgtttgcgatcttcattaagctgaccgctacggatttcaaggctccatgcgcctcaaccaaggcatcatgggtagctagggcctcgaatttattcggagcggttacaaaaggaagcccagtcaactctgatatcttcttagcgacacactcgtcataattgaccggggcgttaataccggtcccaaccgccgtacctcctaaagccaattcggagatatgcgatagggaatcctttactttccgtataccatattctaattgagccgcatagccactgaactcttgccccaatgtcaatggagtggcatccataaaatgagtcctcccgatcttcacgatcttcatgaactcctcactttttagcgccaacgcacgatacagactctccaatcccgggatcgtcacctccgctatcaccttataggcggcaatatgcatagcggaaggaaacgtatcattggaggattgcgatttattcacgtcatcgttcggaagcagcactttctccttatccgttagctttcctccgctcagcacatgtgcccggttggcgatcacctcattgacattcatattcgtctgggtcccgctccccgtttgccatacaatcaaggggaaggagtcatttaatttacccgccaagatctcgtcgcataccttaccgatcaactcgcatttctccggagacaagacaccggcgtctttattagccaaagccgctccttttttcaagtaagcgaacgcctctatcacctcttcgggcatccggctaatatcggtggcgatcttgaaattattcacgctccgttgtgtttgcggcccataataaacgtccgccggcacttccacctcacctaaggtatctttctctattctatacttcatgacacataagttttattaatctcttctatgtataaactatctggatatcgaattgtttatgttacattcacgagtatatcatgaaaagacatttatcatggaacagaattcagatcatagagaaacggcttatttcgcctccgatgttttttaatagtttttcttctcgtcaataatgtattcgggacgggccttgatctcgtcaaagaggataccgacatattgccctaacacgccgaccgtcaataactgtacacctccaaagaagataatggaagtcatgatagaagtccagccaacctcggcgttactaaaaccatagatcttgcccaacgtgaaccaaaccgccaagattataccgaccaatacggatataaacccgagactcgtcgccaaacgcaacggcttcttcgagaaataaagcattgccgtcgacgcgaatttcagcatcttactaatcggatatttcgtctcgccggcgatacgcgcctcacgctcataataaaacggcacttggtggaagcccacccagcttatcaagccacggatatattttccccgttccttaaaacggtcgaactcattcatcaccttccggtccactaaacggaaatctcccgtatccagcgggaaatggacctcgctcatataattcatcacccggtaaaaagccttggaggtgaacagcttgaaaagactctccccttcccgtgacttacggacgcaataaaccacgttagcattctctctctcctgcacttccagcagatccggaatcaattccggcggatcctgcatatcggcgtcgatgataatcgccaaatcagcgtcacagttattgatacccgccgttaccgccggttgatgaccgaaattccgggagaagtgaatcaccttcacatgaggatcggtagcggctatatgatccaacaaagaacgtgtcttatcctgactaccatcatttatatagataatctccgtagggttcggcaactttaccaagacctctttcgtacgccgatacgattcctcgatcacggcttcctcgttgtaacacgggactataaccgctaacttcttcatgccttttaagctttaaaggtataaaacttatttactaaaaaattaatcaccgtatagaaagccattccaatcaagtggttgtagtaatgatcgatcgtaagtcgggaattcaagatcagtaccaatccgtactgtaaagcataacaaataataaaagcgatcgtgaaccgaaccgcccctttcgtccatccggtggaacttcccttgaaagtccattgcttgttccagatgaaactgtttaatatgcctgccacatatcccgttaagttagataaaccttcccggcatccgaagagtttcatcatcacccagataacgatcatcgttatcaaggtattgctcaacccgactacaccatacttaatagcttgcttaatcgtctccattcttatttataatctcggaaacctcctccgctgtcaattccttgacattcgtgatcgtgaaaacattcgagaggaaatcgccgtattggttacattcattgatcacccgatccaacgtggcttttatatccgtacgcaccgggatcaagaacaccaactccacatactgctcaccgatcgtcaaacgctcgatctcgcagtccgttttcggcagataataagcgaactcccgctcgattgtctgccgctgatattcttggaaaggtttcttgcctttagacgtcatcaagacatagaaacgcagcttctccccttttcctcccaagccggtcgagatataaatttgtttctcgtcggagaaatcggactctaaggagatacgagactccatcaaagccatgtaggcccaatctgtcacttctgggtccggatgctgggtgtattcctccaacaagcggtacgcacggacggatttcgaggtagccaattgagataacagatatctcttctcggtcttgtccttggtttcctccgtcaacaaagtgttgtacagggtctcgcactcatcctccgataagggacgaggaggccggttttccttccgtacgttttccgagtatttgaaatactccatctgaagttcaaccggcacacgctgttctagtatatggaaatgtccctccatcctactgaaggaatcacggaactttttgaatacatcaccttcttctttcatagatcgtcttttttcgttattaaactcccataaacaagaaacaagaacaaaggtaatgttttttccggaataaataaaaataacgttatttaagctcccgcataaattaaaaacccaagtccgatcacgaataaaataaacatcccgacattcagacgattggaaatggctggtgctcccttgaactctttccagataaggatgccccataaagcggagactagcgtggctccttgccccaatccgtaagatatagccgctcccgctttctctgacgctatcatactgaaagattgaccgatacaccagataacaccccccaatacacccacgaggtgcgtactcatatttcccttaaaataaccgcatatggagacaggcttaccttccaccggatgtttcattgccaatgtgttaaacaagaaattactaacaaatactcctatggcaaaaacaaatacggcggtataaggcgtcaacttcccgggtgccggagaagcgaaattctccatatccatggaagcggcgacaaaacgatagaaaaaggccatgatcacgccggccacaaccgatataaggatccccttccccgatactttcttggtaccgaccaaggctttcttataagccaggccattcaagatgatggcgaccgtgattaaagctacaccgataaagatataagttggttcccccttcgccgccccgaaatagttaaccaatacgcctagcaccaaggctaatccgatcccaaccggaaaagcaaccgacaatccgcaaatggcgatcgccgcagacaacaagatattggcagcattaaaaataataccgcccaaaaaggcactccctaaactagcgaggttcgcttgcgccaaatccggcaggaaactgcgtccttccgtcccgatgctacccaaggtaaagccggaaatcagagaaaagagcaagacaccaatcacgtagtcccaatagaagaactcatatctccaagtcttggaggctaatttctgcgtattcccccacgatccccaacaaagcatcgtaacgacacagaatatgacagctaaagaataatcttgtacgatatacataaaaatactatttaatagatcgttgatgcatcatataattctctatcaaggaagcgacctccgtaggcggcatcttctcgatcaaacgaagatcacggccattgggatttgccacccaattgttagtcccctcatcatctacgacatgaaaggttcctcgctctacatcgaaataaggctcataaccttttatagcgaccaataccgccgtatgatcccagctcatgcgcccttctgggtctccctccgcaaaacaaagggcatacgcatcttttacaggactgttctccacgttcatttgcaccagtttctttccggtcaagattacgttcccgatctcaaaaccgctaaagacaatctctgtaggccattcctccgctacgactttagaggcagggacatcgcaatacacattgaattctttaccttccggaaacaggcccgccatagaaaccaaacgtttcactttcttggcgactaattcctttccggagagatcgctatattcatcagctcccgattgaagcaaatcccttaaattagagaagaaaccaatcgtacaaataacaacgctggtatccggttgttcgctcagaatcttacgatacaccttcagggcatccggagcgtcggaagtcttcgccgtatgatgcggatagttagcgggtaactcgtcagtccacttcgttttatgccaagtagtcaaggaggcccccggttcgctctttggtgcccctaccggtatgtccggacggttgaaataagtattcagcacctcaatgcaaggcaccacccgctcatcatggttggaggaaagagtcgcaagaatatttacctgaccgctatccgccaaggcatgcatcaaggccatagcgcccacatcatcatagtccggacctaaatcggtatctagaataagatttaccggttgaggcttatcggtttgagaaacattccccttacaggagataaacaaggcgaataagcccatcagaaacaatgatttcttcataatctttataattttattggtgaacaatctctttcggagcatccgagtaaatcagtatctcaccgaaatgtacggagacatcattacgtggatttagccatttaaacgtagccgtatgttttcccttgggcagctgatacttccaaaacaggtcgttcctacgagtcgtataggatgccggaaggttcgccgtctcaaccagctccccatctaggtacatctctactttcgctacgtatttatcatctttagcgttcacaaagcctttgaatacggcgcctgttccctcaaatggaagttctcctacatcggacaaattcttattaaccgccactttctctatcggatacataccctcgaaagccttctcgtaacgaacggctacaggttgctggcatttgatcgtcacctcgtcacctgaaacggaaccgccgttgcgctctatcacttgcaacgcttgatcgaagcccatttggtaagtcttattcaatgagatggtcgtataggcaaaatccatattctccacctctctcaagttcttcatccaataatccggtatacggctataaccaaggattgttcctaagataccacccgcagaggctgggttgcaatccgaatcttgtccacaacgggtagagatatccaatgtcttatagaaatctccctcaccataaagcaagccgataagaatgtatgcgctattgatcacggcatcgatattgaacggaacgaaaacgccatccggacaaccaatatccgagctccatttcttctcacactcaaaccaagtgcgtttccaatcgtccggatattccttatgccagcggatcacatcgctcatacatttataataggtactttgctccggtatcgtctttaacgcctcggtcacgataaactcgatatcatccgagataaacgataacgaatacatcgccccgacatacacaccgccgtaccaaccgtctccgtaattcatgatatgcccgatcttatcagaaatctcggaagccgtattcggcatacccggcgacatcagtccggcatagtccgcctcgatctgataatccagatcatccgcatgagggttattcagccaatggccggacgccggaggcatgatcccttgcaaaatattataacgtgccgactggttagcatgccataacgtatatcccgccgtagcgaacgccatggcgaatgagtccacaggagcgtccaatcccaaccggtcaaagacatccacgaatgtaaggtccatataaacatcatcgtacaatccgggtacattctcgtaccaccacttgatatatccgtccggccatacgatcggtacgtattcttgaatcatcgttccgttatatttgaactccgtcggaccgccatacgtacagcctatggtttgtccggcccaacctcccttaatcttatccatcaacttttctttactaatcgtaaactcagcgggcaccgtcgtttgatcctttgccgagggttgttgggaacatgaggtcgcccctagaaataaagaggctaccgttatcaccgcaaatactgtttgtttcataatattagattgtttttatagattaatcaaaaatatccacctcattccggtaaggaacagaagattgcgctcccacacgagtcacggaaatggcggaagctttgcaagcgaatctcacggcttcccttaaatcccgcccctcagccaaagccaccgttaaagcgccgttgaaaatatccccggcggcagtagtatcaacggcttccacttttatcgcaggaaccatatctaccatggaatcacaatagatcaaagctccttttgagcctaaagtaacgattacgttctgtactcccatctccattataacttgcgcagccttctttgcggaaacctcatccgtgatcttcacgccagagatcatctctgcctctgtctcattcggggtaatcatatacagatgccggagtaacgtagccgacaaagtttgagctggagccggattcaatattacccgtttgttcttcttcgatgccatcttagcgacaaactcgacagtatccataggaatctccaattgcattaaaatcaaatcggctttttctatcgcctcttccgatttcgctaaatcagaaggtaatagattagcattagctccggaggccaccacaatacagttttcagcatgagcatccaccgtaatcaacgctacgccagatggattcttcggatctgagaaaatataggaagtatcaatcccctcttcctcaaatagctgctgggattgatgtccgaatatatcactgcctgttttacaaataaacgagacctgtccccctaaccgcacaacagcaaccgcttgattcgctcctttcccacccgggttcataaaaaatgttccgcctaataccgtctctcccggacgagggagatgattcgtctttacgaccatatcggtattgctacttccaacaaccaatatattatgattccgtaagtctttcatgcttttctcttattaatcattcgtttaacaaaaatatcatatattccgcttggtacaccagatttcatgttaatttaaattcattcaccgatgtcgcaaatataaaaagatccaaaatataaaaatcatcaattaatcttcatcgtagataaacccaaatcgatatatttgcatcatacaatttctcatattcactatatatcaaacacttgataacatcaaaagtccatgaataacacatacatattattaatgcttgtcaacaccttgacaaaagctgagaaaagatatttccatctttgcgcaaaccttcaaaacggtgataaggtatacctcaccctttttaatctaatagacgctaatacgtctcccgaacagctgtatacacgcttttgtcagattcaagacgggaagagtttcgagaccgcagtcaaacatttatatcgggtacttctagaatgtttagttagactaagagaaaaacaggatgtccaaacaagaattttcaattatatatcaaaggctggcgtattattcgaacgagaaatatttgatgaagctttcattgaattagataaagcaaaaaaattagcgatcacttatgaaaatgattccttgcttttattgattcggagaacggaactgaaatacttaagcgctctcgattttaaaacaatctcagaaaagcagctggtaaacaagcaaatgaaaatcaatgaagtattaaaatacgcaagaacccttaatcaacatacacagctatacgatattcttaaacaccgtttaattaacaaaggctatatccgttccgacaaacaaaaagaggatttaaacgatctcgtattgagcgaactccatttaatcgcaaacaattcctaccaaggattcgaagcgcaaaagttacatttgctattccaagccacttattatcttaactccggcaattataaatcggctatccgatattaccaagagcttatcaacttatttaacgacaaccaacatttaatattaaatcctcctatctactatttaagttccatacaaggtattttagacagtttatgtattgccggattatatcatgaaactccctttttcctttctaaactagaagaattaacacaaaatgagtactccactgaattcatcttacatctgaaaaccttgatatatatctacaaatccaatagcttgttacaagccggaaactttgaacaggccttagagctaagggataagcaagaaaatgaattactaaaaaaagtaacatcattaggacttgagtctcaattacggttatatctaagcttcgctgtattaggcatgtatacgaaagattatgtacaagctcgcaaatacatgaaaaagatatttagtttgggaaagttattttgcgcatttccttcttacaagatagcaagattggtaaatcttttactccaagcagaattaggcaattatgatttctttgagaacgaaattatttccatcaaaagaaacatccgcttcgagaaacagacttatatcacagaaaagttaatattcaagtttatacagggctatccgcttccatcatacgagaaagctagaaataaacgctggctacaataccaaaaagacattcaaaaaatcgaacaagataaatatgaacgccaacttttaaagacatttgatgtccttgcttggattgagagtaaattaacccaacggtcgctggcagatattcttgcagaaaaagctcactgatagattaatgccagagcaagtcatgacgtatgtaaaacccggctttccataataccactcatctgctgcaacgcccaatccaccaagccttggatatggggaataagacttaatcctctttccgttaagcagtattctactcggggaggaacttccgcatagacctttcgttcgatcagaccatccgattccaacgtgcgcaaggttacggtcagcatacgttgcgatacatccgcgatggttttatggatatcactaaagcgcatggtaccattagcgcttaaagtgataagcactaacatagaccatttatctcctagccggctcaatacgtctctcacggggcaattccccgtcggatgaaagtttttcattttttaaccttttctatttacttgaatctcaacaatggttacatccatgtaagttccttatttataagtgccttcttgttttctctaaaaaaggggcttacttttacgccacaaaagtaataaacttacgaaaaataactattgtatcacttaataatttacgattatggcaaagaaagtagcagttttagcggtaaatccagtaaatggatttggtttgttccaatatttggaatcatttttcgagaatggcattacttataaagtatatgcggtagccgattcagaagagatcaaaacgaactctggcatagctttgacagtagacgatgtgatcgctaatttaaaagggcatgaagatgaatacgacgcaatggtattcgcttgtggcgatgcggttcctgttttccagcagaacgctagcaaacaatacaatatcgatctaatggatgtgattaagaatttcggggaaaagggtaaaattatgattggacattgcgctgccgctatgctcttcgacttcaccggaatcacggaaggaaagaagctagcggtacatccgttggctaagcctgccattagcaaaggacaagcaacagatgaggattccgtagtcgatggcaatttctttacagcgaaagaagaacattatatctgtactatgatgcctcaagttttggaggccttgaagaaataagttctaagtatcttagcttcatcagcaaagtatcttaagttcgtcggcaaagtaacctaagatactttgccgatgaagttaacttcgttgccgatgtaagttgcctataacatatccaccggattctcattcgccgccctccaactttggaacgtgaccactcctaccgtcaggatactgatccctagcaatgcgacaaaataaatcaaataaccgacaggggctttctccataaaattactggcccatctctccataaaataataggaaactggaatcgagataacaaaactaatgagcaagacctttaaatagactttattcaaacgatatagtatctcactcacgaaagatccatacacccgccttataccaatttctcgccgctgatagtggacatcaaacaataccagacttaaaatacctgccaatgccatccagatagataaaacactggataaaataacccggtcgccaaactggatttctttttcatacagatgccgggagaatgtatcgcaaaactcaaaatcaggtaaacatgaaggggaaagttcgttgagcatattcctaatataaagtaaaacattccctttatcagcccccggcatcaactttatataagcgtaaggcatatataattcttcattcgtcacaaaagcgacaggataagtagctagcgactacgatgctttatgtgtggaagcaatcaccacctcatccgtaaatcctaatacccgggcatcattcccccaaaaggttttcatacggtcacccacatgaaggtttaattgccttttcgctttttggtcaaaaaccaaaagcaactctttattcctcccatcttccatccttgagacacgtccctcgttcgcggtaatatccataagggataaaaaattaggtgatacattcaaataataaaaataaatagtctctccattaaactctgcggccccgccacgattctcattagtcgctcctatcttactagcggcgaaagccacatcctcaattcccgcataatcacgcaaacggttggtaaaattctctttatatttctcggttatctccttattcaattctacgacaactacattatcattcccgaaaccaaaggaatgactccgcattgtctctatctgcttataaataaacagtgacaggacgatcaatataattgaaaccgtatactgaaaaccaaccagacattcccgcattctttttccctttggagacaaaccgaaagaaccgttcagcacgattcgctgaggaatagaagtcgcataaatagccggatatgcaccggccaatagtcccgcacacaaagccataaataatccaccaaaaaaaactattcccttcatatgaaagcctcctccaatgcaaccttcataaaccaataacagcaacaaggatatagcataagacaataacgcaaaaagaaaagactccaaccaaagaaatccacgcaaccaccgtaccgagtcccctagaattttgcggatgttaatactttttattcttgccggaaccaatgccattgtaaagtttataaaattaatcactgctatcaataccactagaaacgaggcgctaaacaacaaatccgtttgtcttttattccctgattttatgtaagtaacgctattcatatcattcatataataaatatcgcataaattcaccaaacgggtctgtacctcttggagcctctcgtattgcttgaaggggaatgcttggttaaactgggagcaaatgagatctttttgtgacggatcatctaaaaggacataacaaaggaaaatccagttatcccaatcatccatacaataagtcgacgataaagaagtataaatggcattattcaattgtgtgttttccgggaaatctttataaactcctcctacgactagtgatttccgttccttgctccaaatctcttcttccgcaagcaactccttaccaatagccgatgactcgccaaatatcttccgtgccatactctccggcaaaaggcatttctccggatcatctaagcaatccagtgaaccttccaccaattggaagtcaaatatagaaacgatccccggagtacaggttatcaccggttccttataacctttgagaatctcgtccctcccgatcgtaaaataaacttcccctacgtaaggatttatgatcgtactttccaatatatgtggagaagacgaggcgaacgcttgggcaaaaggcaggatttgcgtaggccattgacttttacttgtcacacaatccaatcgataaatagcctcggctttcgagtgtattttatcaaaagttcgttcggattccgtacggatagctacgctatcaaataaagtaaaggcgataacgaggccgcatatatttagtgttgccgccattttatttaccttcaacgtgataataaaatttcgatatatagagttcatgatacgcttgtttttcgtatataataaattgacacaattctcccctatacccttaaagacagggcataatcatgtctaatccagcatacgacaaagcacatagcaagagtatcgttcttgccaaaagacggattttaatcgaacataacttaccctccgttcgtaaaacaacaaagctaccgacagggtaaacaaagcgaggaaaaaagtcaatgaggcaataagaaacaaaagcttctccccaaaagcggggaaagacgtcaaaggagttatgatttcttgaaaagagatgaaagcagccggctctttattcgctattgaaaataaagatgtagaagcacacacccgtacctccttttgggagaaagaatcgttggcgaccacagtcaatgcggcaaaaacgaccatgcacaaaaacattgcccttaaccattttcataacaagaacaaaattgatcaaaggcaaatgtatggattttcactcaataaatccaaacaataagcatgcaaataacacgaatatgtaaatcattgattatcatcatccttaaaaacatgattatatttctgaaaaaacacgtacatgttttccacaaaagtcgtacatgtttttcggaaaacacgtacacgtttttaccggatcatacgacagaagacaagaacaaatatagaaatagacaataaccctccttattatgatgagaatttccctcatcagtaccgtgtaagtttgagactatatcaaaacccaagccccaactcaaaggcgaaccggaaactatccgtcgagccgaaccaagaatatttagtggtgaacttattcaagaaagtaagccaaatcccgccaccataggaagtatgccaactatgggaacgctcaccgggaaaccagaccctaccataatcaaagcccgcgaatagaccatattttaagggagtgaacggattctttagttttcccatgtccaagcgtaaatccgagtattggtaaaaggattgctttccgataaaacggttatcacgaaatccccttaaatcaatcgtggcggcttgatagaactcatagtcattatcgaataataccgtccccttcatcaaggaggcccaagtaaaacgatccgagaaccgtacgttccatgaaaggcttccctgcgcataggggaaattacgctccggctttttcaaattcattttccatccggccgtccattcggtttccaataggggaagccacgaataaggctgtttcgttatccggtaagtagccccaagacccacgaaataattcgtacggaaaataggatgatcttctccataaaccgtataaatatatcgatcatccgtacgtttagccttatacatatccaaagagccaaagaatgtcaccacctcttccttcctcaaatccatctcgaaggatggattaagcatatacgtccggagcttcacccggttataattctttttttcctctttatagcccgccgtattatttccaaatccgaagaagttctcgaagttacggggtgaagagatggaggcattcaggtataaacgtctccggccgtcataattagggaagacacctgcatacataaaccctttcaaataattatacccgatccgatgctgataggtaaatggggctcgtttaaagccatacatcgtatatgtaaagaacgtacccaaacttatacctttatccgagtcatatattccccacggggtaaaagatatcttatggtattttatcttctggtaatcatatttataatccttatcatagacatgtattttccggttatgattcaattggtattggttctccccctctccggagatcaagtatatcggaaaatctttccgtgtatttcccttcacttcaaacgtatcgtttcccgcaagcccgtataaccacagttccttggtttccctgccggagaattgttgttccaacctacagtctccggtctcgggatcataaatccgtaaaatagttcggtccggcgcttgccgctcgatcaagaaataatcggattgattggttccggcaaccactggcgtacgttgcaataagcgataatattggctggcaaccgcttccagttctagcctccttcgtttcaactttcgtttaatcagttctatctcatcatgttttacaccttccggcaaataagtaaaagcgctatcgatcaaagagtcggtcatctgtttccgaatttcttgggcttggcgtatccaaaccgactcatcactgcggcctgctaccgccatatccagcgcaaaagctagcttattgattttctttgtatcttttaaaatcaagctatcataattacagataaaatccaacgataacatcttcaacatttgcttgaacaatactccgtccaccttcgtgaaagcatgattcctatcgatcacgatcggggtataaattacgctatcattgacggtatgtgattgccactcccagttttcgttcgtcttattccaatctccgatccacatatcgaaaatacgttcccgaatgtatagattttgatccgccatatagtttttactcacttgaaggctgtctagaaagtcttccgtggtatacaaattagaccttaaattaatatccggaacattgattagattgaccagcctatcttgtatgtcgctgccgtccgcaaccgtgtctttccgcatgtgggaaggaatatagtaaatactggagggagaaaaactcaatcccgcggacttcgctaaataatctgcgaccaaaaaggtatagggattgataatcgtataagcatctcctaagaactcatccaaataggtattcttaaaatcagccttattatatatttcccggaaaaacttcgactccaagaaactcgtagagccacccaagggctttagcaaatacaattgcttacgcttattctccaacaataatccgtgaaacccttccgcttgcccgacgatgtccatcccaccccccaacgtttctatcgtagccgaaggaaccctgatcgggatcgtataaaggtgacgataatgcctcccccacatccaattatagatcttgcttttaccactatccgcttgcggataaatggacttacgtacccaatcttgagattgggaataaagcaagccgggcataagcacaaagagtatgagtatgatatatttataggatgaccgcatggacaatttctttctatctctgttttactaataacaggggtaagacaagagttgttttgtttttttagcctaagagaagaatcaaggacttgacgtataaacaagcaataattatatatttttggcagacaaatctaaaatcatgctataaaacattattcagaaaggttataaatacaaagaagaaagttacttttacacgcaatttcaataatattgatacgcatgaagaacataaatacactgtcgggcttgtctgttgctaacttcagcaagcaaattgacgggaaagaaacggcgctttataccctgtgtaacaaggttggagcagagctagcgatcacgaattatggagcgaaaatcgtctcgctgatggttccggataagaacggaaaaatgaccgatgtcgttactggccataattcgattgaagagtacttaacatcagaagaaccttatttcggtgccatttgcggtcgttatggaaatcgtatcgccgctggaaaattcacgatcgacggtgttacttatgacaaattagccataaataatggccccaatagcttgcatggcggaatcaagggattcaatgcggtcgtatgggacgccaagcaaatagacgagcaaaccattgaattgaaatatacctccgccgatggcgaagaaggtttccccggagaactaaagacaaccgtaacttatcatctgacaaatgagaatgaggtcgttatctcctatcaagcctctacggacaaacctacggtcttgaacctaaccaatcattcttattttaacctatccggtgcgggagatccttatataggagaccatatcctcacgatcaacgccgactattacctgcctacagacaatacggcaatcccgtacggacctaaagagaaagtagaaggtacaccgatggacttccggactcctcatgaggtaggcgaacgaatcaatgacaatttcgaacagcttatattcggtaagggatatgaccacacgtacatattaaataaagaagacaacgaactttcttactgcgctcgctgctcctcccccaagaccggtatcgtaatggaaacttatacgactcaaccgggcgtgcaattatacacaggtaactggatgactgggaatttcgaaggtaagaacggacaacgctacccggaacgggccgctttatgtctggaaacccaacatttccccgatagccccaacaaaccggaatatccgacaacggaactccgcccgggcgagattttccaaagtactactatttataaattcagtgtagaataagagaataatttaagtaatctaataatctaaaacaacaaaaaagaaatggaatcaacagcaaaaaagaattacacattgcctattatcatgatggtggctctcttcttcatgatatctttcgtgacgggtctacagaacccattcggtatcatcgttaagaaccagttcgctgccagcaacttcatgtcgcagctgggtaacgcagctaactttatcgcctatgccttcatgggtattccggccggtatgctattgcagaagatcggttacaagaaaaccgctttgttagcgatcatcgtaggtttctgtggtgtaggcatttcttatctttccggtgtggctggtagctacgctgtttatttgacaggtgctttcgtgtccggtttctctatgtgtatgttgaataccgtagtaaacccgatgttgaacacgctaggtggtggtggaaacaaaggtaaccaattaattcaggttgccggttccgtgaactctatcggtgctacgatcgttccggtattggttggttatttgatcggtgacgctgctaaggctcagatcagtgacgctaacccggcattgttcttggctatgggtatctttgccatcgtatttatcgtattgttctgcatgcaaattccagaaccgcatatggttaaggaaaatgaagccaagactccggacaagcacagcgcgctttctttccgtcacttcattttaggtgccatcgcaatcttcttgtatgtgggtgtcgaagtaggtattcctaacttcatgaacttgttcgctacttcttctgagatcggtatcgatcctacagtagccggttctatcgtgggtacatattggttcttgatgatgatcggacgtctgttcggtgcctctttcggagctaagatctctagtaaggcgatgttgtcatcagccgccacggtaggtatgatctttatcttgatcgctatctttgcccctgctacgactaaagttagtatgcctgtattcttgtcagatatctctttcggtatggttgaggttcctgtcggaatcatgttcatggctctttgtggtttatgtacttccatcatgtggggtggtatcttcaacttggcagtagaaggtttaggtaaatatacggcagccgcttccggtatcttcatggtaatggtttgcggtggaggtattcttccgttgatccaaggagccgtagccgacgctggcggtttcattaccagcttctgggtggtattcctaggattggcatatttgctatattacgctttgattggtagcaagaacgtaaacaaagatattcctgttgaataataaggacaggacataatataataaagaagaaattatccggcagagttttctgaatggataatttcttcttgtttattcaattatttaccttaatcaaattaagtatcatgcaacaaaaaatcagaactaaatttaaagagttatttaataccgaaggtagcttatacacatctccgggacgtattaacttgatcggtgaacatactgattataatggaggtttcgtttttccgggtgccgtagataaaggaatgatcgccgagatcaaaccaaatgggacgggcaaagtccgggcgttctccatcgacttaaatgattacgctgaattcggcttgaccgaggaggacgctccttccgcaagctgggcaagatatatctttggcgtatgccgggagattattaaacgaggtggcaatatccaaggtttcgataccgtattcgctggagacgtacctctgggcgctggaatgtcttcttccgccgcattggaaagtacttatgctttcgcattgaatgacttattctcattgaacatcgataaattcgagttggctaagatcggtcaggctacagaacataattattgtggcgtgaattgcggtatcatggaccaattcgcttccgtattcggcaaggccggaagtttgatccgcttggattgccgttctttggaatataaatattatccgtttaatccggttggttacaaactcgtgttattggattcggtcgttaagcacgagttggcgtcctcagcctacaacaaacgccgtaaatcctgtgagaacgtggtagccgccattcgccgcaaccatccggaagtagagttcttacgtgacgctacgatggagatgctgaacgaggtaaaagcggatgtcagcgcagaggattacatgcgtgccgaatatgttatcgaggaaatccaacgcgtactcgacgtatgtgccgctctggagaaaggcgactatgagactgtcggcgaaaagatgtacggcacgcatcagggtatgagcaagctttatgaagttagctgcgaggaactggatttcttgaacaatatcgccaaggaatgtggtgtaaccggttctcgtgtcatgggtggaggattcggtggttgtacgataaacttggttaaggatgagttgtacgacgatttcgtgaagaaagccttctctgcttataaagagaagtttggccgtgaacctaaattatataatgtagtaatcagcgacggagcacgcaagctctgttaatctttaaaatccataaaacgatgtcagcagctttttatcaagacgaagtaaaattctatgttgccgtagattgtatcattctagggtttaacaataaggagttgaatgttttattatacaaacgttcgttcgagccgatgaaaggacaatggtcccttatgggaggcttcgtgaaatccggggaaagcgtgaatgaagcagcatcacgggtattaacggattgcacgggtatcgagcatctttttatggaacaaataggggcttacggagatgtatcgcgtgacttaggggaacgggttatctccgtagcttactattccttggtgaatatgaatgatttcagccccgagatcttggaaagccataacgctacttggaccaagatatccgagcttcccgacttgattttcgaccataaccaaatgataaacgatacgttgtccgtccttaaaaagaaggcggcaagccgccctatcggtttcaatttgcttcccgagcaatttaccttgccccaactacagacattgtatgaggccatttaccaaacccctttagacaaacggaactttcgcaaaaagctaaacgccatggatattctggagaaactggatatcaaagacaagaaaagttccaaacgaggagctttcctctacaaattcaacgagaaaaaatacaacaaatgggttgaacagggtttcgacttctcgctctaatccgaatgatgtatatccgcaagaataaggcgctcagcgggctatcttaaatatctctcaatttatcaaaaatataagaagataggaacctttaccgaaaaggaattgtttgattgatataacggctcttacaaagagtttgattatctttgcagtcaaataaataattcatctgataaaatgaacgatattcaagtaatgaacaaagcagctgataacatccgtatactggctgcgtcaatggtggagaaagcgaactccgggcacccgggtggcgctatgggtggtgcagactttgttaacgtactgttctcagagttcttaatatacgatcccaagaatcccaaatgggaaggacgcgatcgtttcttccttgacccggggcatatgtctccgatgctttattccgtactggctttaagcggcaaattcacattggatgaacttcaacagttccgccaatggggaagcgttactccgggacatcctgaggtagacgttatgcgtggtatcgaaaatacgtccggcccgttgggacaaggacatacttatgcggtaggtgcggctatcgcggctaaattcttgaaagcacgtctgggtgaggaagtaatgaaccagactatttacgcatatatttccgatggaggtatccaagaggaaatctcccaaggtgccggacgtatcgccggaactttaggactggacaacttgatcatgttctacgacgctaacaacgtacagctatctaccaaggtagaagacgttgacgcagagaacgtagccatgaaatacgaggcttggggctggaaagtcattcaaataaacggtaacgacgtaaacgagatccgcaaggctttaaaagaggctaaggcagagatctccaaaccgactttgatcatcggtaacaccgttatggggaaaggtgctgtcggcgctgataacagttgttacgagaataaggtatctactcacggacaacctttatctgcggcaggagcttctatagcggatacgattaagaacctaggaggtgatccggaacatccgttcgcaatccttcctgaggtagccgaattatatgccaaacgcacgaaagaattggaagtaatcgtcgccgaacgttacgccgtgaaagacgtatgggcgaaagctcacccggacttagcggctaagatggagcaatggttctccggaaaggctcctcaaatcgactgggccgcaatcgagcagaaagcgaaccaagcgacccgtgccgcttccgctaccgtattaggagtgcttgctacccatgtagaaaacatgatcgtcgcttccgccgacctttccaattccgataagacagacggcttcttgaaaaagacccatgctttcgtgaaaggcgactttagcggagctttcttccaagcgggtgtagccgagctttctatggcttgtatctgtatcggtatgtctttacatggtggcgtgatcgccgcttgcggtacattcttcgtattctccgattacatgaaacctgcgttacgtatggccgcgttgatggagcagcccgttaagttcatctggacacacgacgctttccgtgttggagaagacggacctacgcacgagccggtagagcaagaagctcaagttcgtttattagagaaattgaagaatcataagggacacaactccatgttggtacttcgtccggcagacgttgtggagacaacagtcgcatggaaactagcgatggagaacgtttacactcctaccgcgttgattctttcccgtcagaatatcacagatcttcccgctaaggaaaaccgctatcaagaggctttgcaggcggaaaagggtgcctatatcgtcaatgaagacgctaacgcagatgtaattcttttggcttccggttccgaggtatcaactttggtcgagggcgccgccttacttcgtgctgaaggcataaaggttcgtatcgtttccgttccttccgaaggtctattccgttcacaaagcaaagagtaccaagaatccattcttcccgcaggaagcaggattttcggcttaaccgctggtcttccggttaatctggaaggtttggtaggtcctaacggcaaggtatggggacttgaatccttcggtttctccgccccttacaaagtattggacgagaaattaggtttcacggctaagaacgtttataaccaagtaaaagaattattagcataaagatgggtatagtaggtttgtgtagcgatcacgctggttttgagttaaaagaatatataaagacaatcctcgataaaaggggattgtcttataaagattttggaacttattcttctgacagttgcgattatccggatttcgcccatctgatgggcaaggccgtagaagctggcgaggtttatccgggaatagctgtctgcggtacagggaatggcattagtatgaccttgaacaaacatcggggtgtccgtgccgccttatgctggcgagaggatatcgcgaaactggcacgtgagcataacgacgcgaacgtgttatcaatgcccggtcgttttatcagcaaggaagaggctaagaaaatcgttgagatattcttggatacaccttttgagggtggtcgccaccaacgtcgtatagacaagatccctttgtagagtccgcgtaaaagtcactttataaaataaagaaggctctcccatggttcgcttaccattcggagagccttttcgtatcaccgtttaaacggcaacgtacatataatagatgacggatgccaaatttgaggactttctactattaaacagtcgatctcgctttttgttctttccatttagttaaaaatgtacgggctaccgtcgggaacaactccagcaacagtatttctttctcattctcagctaatagcacatccaaatcctccaatacaggattctcttgcatcacgtaatgggaaccgtcgtaaggcacctcattttgtacgccggcgattttcaaccgaaacgccggatctaccggaatcggcgtcttgccatactctccttttaccaaggcgataaactggttggaaggattactatacatcgggcgacctttcagctcatccagcgcacaggaaaccgcttgcgccccgataatctggctcgtaggcgtcaccaacggaggtaagccggcatccatccgtacttgcggaatgagcgacatcgccttctccaacaagtcgatctgccccaattgcttcaactgggcaaccatattcgtatacatacctcccgggatctgcgcttttttcaccaactcgttcggctcggggaaatcaaaatactcctcgatcgcacggcaataaagcagcaaatcgtcctccttatctttccgggcggcctcgatggcatcgttgaagaagcggtcgatctcggcggggaaactatcctctacgggattaaagggcctcgggaatttcttcgcggtatcgaacacggaaagctccttgcggatcgtcaataactccttgttgatcttagcgatcgcgtccatatcaagatccagctcgatacccaatttcttgcagaagatatagaccagctccacggcgggagcggccggtcctccggcgaagttccagatattcgtatcaacgatgtccaccccattgataatggcggatacgaccgacgccaatccgtaaccgggcgtactatgcgtatggaaatccaccggtaccttcaggctcttcttgaacaatcgcaccaattccgccgtacgagccggaggtatcaaaccactcatatccttcagggtgatcatatcagcgcccagcgactccagttgaagggccttgtttaagaaatactcattcgtaaaaacaggcttatgcaagggccgtccatgcaaggcggcttttatacgttctaccggggaatggtgaggatctatcgtataacagatggcacagtcagcctttcccccgaatttcttcacataacggatcgtggatttcacgttatccacgtcgttcaaagcatcgaaaatacgcatgatatcgataccagaacgaatcgagttccggcaaaagccttctataatctcgtcgggataaggattataaccgaataaattacgcccacgggaaagagcggataacttggaggaatttcctattttctctttgatgatctctaaacgatcccacggattctcacctaaataacgcatcacggaatcgggaaccgccccaccccatacttccatggcataaaagcctgcgtctttgtagtaaggaagtacacggtctatttgcgcttgagacattcttgtagcgaatgccgattgctgaccatcgcgaagagtcaaatcacgaatcaataatttacgtatcataccaaatttgtttagatcgttttagtcaatattctgattatataacaagatctaaacaaatttgataaagattacggggttaataataaccaatttttctaaaacctcagtcttttacttccacaacgatcattacgggaaagtggtcggaaggggtacgggcctcatatttactcaatgacacctctttcgggaaattaccgttttgctccttccgggcgctttctttcgcctcggagcgataagtatccgttaagattccatacttcttcacctcaaattctttcgtaagaaaaaggtggtcgatacggctatcggtcttgcggtccggatggaaaccgttgaaggtaccattcggggcatagcggaaatcagcgatctcataagagtcacgcatgataccggaaccatctaacaactgataggactcacttgtttggtccacgttgaaatcgccggtaaggatagcgggaagtttcttggggaactccttgatcttctccaagatcagcttggcgctctcggcacgtgcctgtacgcctacatggtccatgtgaaggttgaagaacaagaaagtgaaaccggtttgcttatcccggaactcaccccacgtacagatacggggaaggacggcatcccagcccttattcggacggtcggtgatctcggatagccagaaatcgccatgctccaaaacctcgaacttgtccgtgcggtaaaagatagccgaatgctctcccgcccgcttaccatcgtcacgtcccacaccgatataatcatatccgggcatggcttgcctcaagtcctgcaattgcgaatatttgccctcttgggtaccaaagatatcgaacccgtgaaattgtacgatctgggcgatgtagggatagcgttgtccccaaccgttaccgttcgtggaatcgccgccgttggcgttacgcaaattataggtggcaaccaccattgtctccgcctgtaaggttaatacggcgcaaaaaagaaaaataaaagaataaataactttcttcatgatctatgtttttaattatcctcgaaagctgataatatcggacgggcgatccacacctgcggctgcggtacgtccaataggtaagccatcgtaccggcgatatcatataccatcgtgctctccgggatcttgaagcctttctttacgttctttccatagaaaacgatcggggtttgcatctcgttcatcgtcttgccaccgtgaccggtctcgataccgccgtggtcggccgtcagtataaccaccgtatcatccatgatacccgcctcacgaacggcgtccatcacttgcgtcaagcaactgtccaaatgattcaccatggcgaaatactccggggaactccatcccttgccatgtccggtaccatccggctgatcgtatataatcgcgcaaaggttcggcttcttctccttgatatactgaacggctaccggggtacatccgttcgggttctcagccgacatcggggcatgcttacggaagctcatggccaaggtatccaccagataattcatgccttcccactcatagatatagccaatctcagcctcgggagccttatcccggtacatgccgaagatattcgggaaacggttgtcgctattcacgacacgggaaggaagctccggcgtacgagatccccactccgtatatccgtgcaactccggtcctgctcccataaacatggaagcccaattacaagcactcgacgaaggcaggatcgaacgattctctaacgtggaagcaccttccgccatcatcttacggaaagtaggcatatccgccccattattcaagcaatgggcgctcaagccgtcgaaaccaatcaagattacatgctttggcagattcttctctttcaaaggcacttgctgaggtgccgtattacaggcgctcaggcagtatgcgattaccgcacaacaaataaataagatttgctttttcatcttaccgtgtttttcttttatgattaatattgaagtatcttagattccgtcagacaaaggtacaaagtttaaataaagttcaaaaagatcatttatctttgtagcttaatctaatcttattttaataaatacgtatgtacaaacatttcctgacaagcgtattgcttgtatttttcatgctatcctgtagcaaactttccccttttgaaggaaagatgcgagaatgcgtacaaacctccctaagctggagaaacgacacgaccggtatctgggaaacagcaggctggtggaactcggcgaacgtattaaccgccaccattcgctacggtgccgtaaccaaagatccggccatcccttctgtcatagaggatgtattcgagaaagcccgtcattaccaagtaggcgtagactcaaccggtactccccgttattgcgacaacttcatcaacgattattacgatgacgagggttggtgggcattggcatggatcgaggcctccaaactgaccggagagaaaaagtacctagatatggccgagatcatattcgatgatatgacaaccggctggagcgacgcttgcggaggcggcattttctggaagaagaatccactgcattacaagaactcgattgccaacaacttattctcccttacggcgatccgtttatataaagcgacccagaatccggcatacctcgactggttcaagaagaacgtagattggtatatgcgaaccggcatgatcaatacgaacatctaccaaatcgaagacggtaccaaagacgattgtacccccaaccgaaatgcccactacacctataaccaaggcgtagccatcgctgtcttagccgagatgtatctccaaaccaacgataaatcttatttggaactagcggaaaagatcgccgacgctaccatcaccacacaattgataactgacgagggtattctccgtgaaatgaagcccgagatcgatgatagcaacgacggtgtccaatttaagggtatcttcatccgtcatttagccttcctgtatgaagtgacaaagaatccggcttataaagatttcatcttgaaaaatgcggaatccatcatcacaaaagattatgatcccacatccaaaagcttcggttgttattggtacggccctttccacaaggaaaactcggcagcaaacgcttgcgctttggaatgcgtgatagaggcttatgatttaacgaaataggtatccggaaagacgcagcttgtcgttattcacatagccaacgggcgatattccgctctggctcccccggagctggaacggatgtaacatacggctctggctcattgacaaaaaaacgggacggcggacatctccgccgtcccgcccaaaagagacagccttatctctgtttgtattcatgtcaaggctggttttttactgataacggggccatataaaccctgtttttcatatcgtgcacaaacataagacttctttttcacaaaagaacaaattccttcttctttctagaaatacatgctttataacataccgcactccctctcggttgctagcgtggacttctattacaaaggataggcgacgcagcacgctacgtctccctccgttttctttttaccaataataggtatccataatctccttcattttaggggtattcgtgtcctcatccttaacatctttccgcagcttcagcatctcctccttcatttgccggatgatcttggcgtattggggatcgttataagcgttgtgattctcacgaggatcggattgaaggtcgtaaaactcccatgctggtgtcgtggtcttatcctccgaaccagtcatattcagacggtcgccatagaaaaacatcagtttataccgctcattacggatacccatatgggccggacggttcgaatgttgggtccaataacgataatacatctccttacgccaatcctttggggtatttcctttcagattatcgcgaaaactatggccctgcgattcattcggggtcttcacgcctgcgtaatccgccagcaaagaggcaaaatccacgttcaagatcatatccttattgcgggtccccgccgggatctctttcgggtaacggatcacgaaaggcatacgtagagactcctcatacatcatacgcttatcgaagaaaccatgctctcctaagaaataaccttggtcggatacgtacaccacgatcgtattatcggcgattcccatatcgtccagcgctttcaataacttcccgatattatcgtcgatcgtagccccgcaacgcagatagtcgcgcaccaatttctggtaagcggcgctacgggcggcagatcgatgcatccccttcgtcgtaaaaggcaactccggataccggcaccaccatttatcagggtcttgcgacgccacgtcccaacgacgggccaactcctccaaaggctgtccggagaaagtacgtccattcgtctccggcccccaatcaaataagttctccggttccgggaaaacaacgccgtcatacaaatgcctcatccgttctggaaaatcccaaggttcgtgtgtagccttgaaatgacaacacatcatgaaaggccggtccttatcggcctctttcatccaacggatcgccttatctgtcacgatatccgtggagaaacctcgtacccgctccccgaaattacgctcacccggccaaggttccgtacaatttataaaagtagggtctcggtactcgccttggtcatggaacacggaatagaagtcgaaaccttgcggttgcgttttcagatgccatttaccgaccaaagcggtctgatagcctcccgcccgcatttgcttggcgatattatcctgctccggatcaaaagaatcacttaacgtgtagacaccgttcacgtgactataggctccggtcaagatcgccgcgcgactcggagaagagatcgagttcgtacaaaaacaattatccaatacgcaaccctccgcagccaagcgacggatattctcgttgcgggcatattcccccaacacgcccccgtaaataccccacgattgggaagtatgatcatccgataggataaacaagatattgggacgttcctcttgcgccggtttattggcggcaaagagagactgcccgtttcccgaaagacaacaggcagtcattccgatactaatgatcgattgtttcataagtcatgacgttttttcccttgtactaaacccggttccctacgttccgtacccttcatacgagtcaagtcatcccctaactcatggcgtttctggtccgcgatcttcatcaatttagcggcttcctccggatattgggtaatcacgttataacgctctcccggatcacggcgcaggtcgtacatctccggcttcatgatctccagattcgtcaacttacccggctggccgtcgtttcccggctcataagccccataagtaacgtatttatgggggaataccaatttgaacattccatccgtaacagcctccaagtcattctttcgatagtaatagacgaaagactcacgtgggttggcgtcttttttaccctcgatcaacggcaagatacttactccgtcaatcttgcgaggaggaagcggagcctgcgtgatctcggcgaacgtaggaagaaggtcgatattagaagctaacttattacaagtcgtgcccggtaacgtcttacctttccagtacatgatacaaggaacccggttaccaccatcaaaggtcgtagcctttgcctcacgtaacccaccagctgaaccggcatgattcccgtaattggtccaagggccattatcggaagtcaagatcaccaacgtattatcttccaagcccagctcacgcaatgccttgaatatctcacctacactccagtcgatctccatcatcacgtcgccatataaaccctgctcgctctttcccttgaatttatcggaaacggccaacggtacatggggcatattatgggccagatacaagaagaaaggcttattcttattcttcttgatgaaattaacagaacgggtggtataatccgtagtcaaccgtgtttggtccgtattataaccgataatctcatttccgtcataagtcggcaaatctgggaaattaaagacctcaccttgttgcgggtggaatggccacatatcgttagaatacggcaacccataatactcatcgaagccattttgcaaggggaggaactccttttggctacctaaatgccatttaccgaagatagcggtactatatcctttctgtttcaatacctctgcgatcgtcatctcctctggatggacaccgtagttcgaatctggccccggagcgccggaaaaaccgatacgattcggatagcagccggtcaacaagccggcacgagaggctccactgatcggttgtcctaccaaaaagtgcgtaaaacgaacgccttccgccgccatcttatcgatattcggagtggtatatccgtaagctccattaaaagaaaaatctccgtaacccacatcatccaaattgattaggacgatattcgtgtaatcagcggctatgcctgccattgaaaaagctgaggcggccgtcagtaacattagtttattcttcatgatattatttattgaaatattggctttgaagtgccatcctgtgtttggcacttcaaagataacagtttttaatttacccaagaattaatcccagttcggattttgctccaaattagggttcaagactgtttggttataagggatcggccataaataatctcgtttcggattaaaagaacgtttcacgacttctattccctcataattatgcatcataccattattttctttctcggcggttttccagcgcaagatatccgaatagtagagtccttcaaaggtcaactcgatacggcgttcacggcggattacctcacgcatctgatctttcgtcaaaccttttggtacttccggcatattgatatccggacgcctacgcaattggttgatggcatcataaactgactgatcaggaccactcgcctcattctgcgcctcggcatacgtcaacagaacttccgcataacgaatcaaaatgaaattgaaagccgaacgttctactaaaggaatcgttacatcatcctcataagaagtgtatttcttcacaccgaaacccgtagtcgccacatcttcttttgtgatcgtctttcctaaatacggataaccgatgcaaacgatcgatttcaataaacggggatctctgttctcatacggacgagtcggatcataaagtggtgactcttctatcgtcttcccgtcaacacagagatatgtatcaaccagttccttcaagggagccggacgattcaagcgccagatattctgatcataatccgttggatactctggcaatttcgcttctatatcaaagattacctcacaattatatttattatcttcgctaaagaaatgacgataatcattgaataattgataaacgccagactccattacctgcttagcagcttgggccgcctccgcccaacgagaattatataataaagtacgggcttttaacgctaatgcggcaccttttgtcgcacgtcccaagtctgagctagcataggtgtccggtagcacggcagcggcctcctccaaatccttgacaatctgattcactacctcttccttggaattgcgaggtaattcggcttgctcatccgcattgggagcatctataatcagcggtacacctccgaatttatcgaccagacttaaataatagaaagctcgtaagaacttggcttcacccaccatcttcgccttctccgactcatccatatcgacacctccgacattagcgatgaaagtattcgtacggccaatgccaacgtaacagttcttccataagcttccgattaaagccgtagtagacaaatgttcaccttttccaattgcttgcgtaccattcgcctcgttataaggcatcgcattcgctgtcaacatatcgaattccatcgtatgcaatgaacgccaaggtttcaatgcgttgtaacatcccattataccggcgctcgcatgctcttttgtcttccagaatgtttccgtggaatattgatcggaaggatctacatccaaccagctatcacaagcggttaaactcatacaagcgacagcgacacatatcatcttatatattttacgtctcatattattattccttattatttaaaatgtgacattaacacctgccgtataagtccgtacagacggataggcataccagttgcttcccttcaagttcttctccggatcaaaatccttcatcggagagaacgtgaataagttttgcgcattgacaaagaccttcaatctcttaacaacaccgcttttcaagaaagagaccggtacgttataagaaagttgcaagttcttcaaacgtaaataagaggcgtttctcaaccagaaatcatttgtacggaaattctcgttcaagcatccttcatatgtagtcaagataggcaatgtagcgctggttccccgctcgggagtccaagcatccgtcaaccattgttccggcaaaccacaaccaaaccataaaggagtagcaccaatgcggtctccatatgtatagacatcagttacaccttggaagaaagcgctcagatcccaatccttatatcctaagttgatattgaatccataagttatcttaggaatcacaccaccacgtatctggcggtcatcttcggtaattttcccatctccattcgtatcctcaaacttcagatatcccggtttagtagccgcggtttgatacggactattcttgatttcctcctcagattggaaaataccgatagcatgaagcatataataagaatcgataggctttccttcttccaagataaacattccatcaatgattgtttgccccttcaagctaacgatcttatttttgataaaggtcatatttccatttacctcgtaacggaagttcccgatattgttccgataccccatattcaactcgaaacctttattgctcacctcgccgatattacggatcggcccatccagaccacctacttgatccggcaaagtaaccttacgcaagatgtcggaagtacgtttatcaaagaactcgaaagagaaatccaagtttccgtttaataagctagcgtcaataccgacattcgtcatggtcgttgtctcccatgtaatgttcggatcgttataggcggtaatagccgctccggattgcatcgctccattcaacgggtagttataatccgtgattgaaccatcattttttatcaccttcaagttcattaggtccacgtagcggaacaaatcgatacgctcgttacccaattgtccccaagaagctctcaatttcagattgtagatccaaggaatatctttcataaattcttcctcgctcaaacgccatccggcagagaatgaagggaaaataccccaacgatttcctttggcaaaacgggacgaaccatcataacgaaagttaccctcaaataaataacggtctttataaccataattcaccctaccaaaataagacatcaagactgatctcgaggaagtgcccgctacactcggattactagaacccgcatttaattcgtgcaactcgttccctaagaaaccttctaccttagcggaaaattcagtcttatcatcactctcaaaactatagccagccaagacttttacgtcatgggcatcattgaacttcttgccccaagataaggtattgaataccgtaactgccaagttattcttatcacctttataagcatggcgtgtattctgaccgtcataaaccactcgtttctcctcattggtcttcaactgatattcgtatacatcaggcgcaaaacgagattgcagataatcatatttgtttaaaccgacattcaagttataaacgatatcaaacggaagcttatattccgcagacaaattcgccaacatacgcaaggacttatgcttgttctcgccctcatcggccaacgccaacggatggcgatagatattatgcccaggagtacggataaaagtatccgcatagcgaccatcggccgtataagtcgggtggaaagcctgcgctttataagtcatctccactaagtttgccacacccgctaccggctcattatagatctggtaatgcgcattgatattagcgccgatcttcaagcggctattcacttgagcagtcgtattcacagctaaagtatatttattagaatccgttccacgcaatactccattttgatcaccatagcctaaagatacggaatacgtatatttatcatcacctccggagaaacgcatgttatgctccataataaaggcattattatacatgatatccaaccaattattctgcggatacataatcgggtctgttaacatgccttgtttgtactcctcgattaacgcatcagaataatccaccgttagtttaccttcgttccgttgcgcttggtttctcatttccataaacacgaccggatcatatacgaagttaggcagataggtagcctgctgcacgccgaaatagttattataatcgacggtaaacttacctttctttcccccctttgtctttaccaagacaacgccattcgccgcacgagaaccgtagatagcggaagaagccgcatctttcaatacggaaatactctcaatatcattcggatttaccgcttccaacgggaactcgataccatccaccaaaatcaacgggttattatcgttcaaggttccctgaccacgaatacgaatcgtcgccccgtccgctcccggctgagcacccgcttgatttacgtaaacaccttgcgtaccttgcaacgcttgggtcgagttggtgatcggacgattctccaacgtctccgcatccaaagaggagatcgctcccgttaaattcactttcttctgcgttccgtaacctacgaccacaacctcatccaacttctgggtatcctcggacaggctaaccattactttcgaagaattaccgacctcgaccgtacgatccgtataaccgatataagaaactaccaagatcgcattgtccggtacttccagactgaagtttccatcgatatccgtaatcgttccgttcgtagtgcctttaacgacaacattcgccccgataatgggttctcccaacgcatcttttacttgtccggtaatctttcgtggcgaagactggaataaggcattcggatgtgagacacttgaaacactctttgacttaattataatctgccggtctacaatctcatattggtatcccgtatttttcaaggcttgctctaagacctcctctaacgaggcattatttgcttttacactcgttttcctatttacatttacttgattatcattcaagaagaacgtgtactcactatttttctctatttcttttagcacttccgatatactgcaatcctgtttattcatggaaagcttataattctgtccataggtagaagcggatacagtacatgcgaaagccaaggataacaacgtacttatcttcatgactcggtttacttttctgatttttttcataactttgtaatgtttctgatgaataaattagcaggtgtgtcggcctctcaactcctaacgcctgccgtcaagaacatttgatcaggaggagaaacctagtttgtcctcctgtttttttattagacttaagaactgttaacaagcatatcttttagaatttaacgttagacactcatttatctccctttatatatagttcatattcattgtctttctctctgtatttaatgggcgatgtattgctcagcataaacaggattcgctccaaggattcatcccgtaccttaaacgtaaaccgatatttctccgctatctccttcgggcactttatcttccgcccgaaccaaggctccagacgggtaaggatcatgctcaagcgttcgttctcaaaactgaggacaccgttacgccaacccgaatactcttcggcattaaccgtcttaactctaacggtattcgcttgtttgtcgaaaaccaacatctcgttcggattcaatatcacctcacgcctgttcttcacattgggacctcccaagccaatcttcaccttaccgtttaacaggatcgtctccaatttgctctcggagtcataattgaaaacctcgaaggccgtgcccaaggccgttacatccatgttcttggtatgcacggtaaatggtctttcccgatctttcgccacgtcgaagaaggcttgcccttttaattccacatcacgggtcttgccatcgaaactctttgggtagatcaattggctattaggccccattctcacggtcgtaccgtccgataaggaaaccgactctatgcaacggacaccggaggccattacatatatatattgatcttctttcgtatgagaccaataaactacgcttcctacacctaaaagtagcaatatggaggcggctatcgccgtaatcttatagacccagagtttacggacaccgtttgtcgccattgtccgggctatgattcgttcccacatgcgattccccaccacgggattcacgcgatccgcagcctcgtcccattgggaacgcatacgctcttccacttttgggtcacacagcaaacgttgccgatctttctcatccagagcatcccgcatcaacttcttcaatatcgttctcgtatcttcgctcatgtttattattcttgttctatttataaatacacgccatgttttccttccccctattgggtgataaaaaaatttcacttaggtatacaagaaatataacggatcttccttgctttccatccttatatttccgtcctttgtattcaatgaaattggttgccgacggtgtcggcagtatttccgacgccgtcagcaatatttccgacagcgtcagcagcattgccgagggcgtcggcaaccgatttcatcaaatagaaacgccaaagagataaacgttaaatctccgaggcatcctatacattatccatttaaataacgagaaaatcatgggaaaaccaagaagtggcatccaagtcagtatttataatacaccgggcaatgaacaatgcgggccaacatcctgcgcacgagtcatcaccagagataccaaacgcatgaacgatatatgtgagtatatttccgaatgctcatccgtcacctccgccgacataaaaggtgtattggaggcgcttacttcctatatcggcagggaattatcctatgggtacagcgtggaactggaaggattgggacatttctcgccatcggtaaaaagcaaagaagtaacggaccagaaaggaaatactaaatcaagcgctagcatacacggcgttaacttccgctgctctccccgactgaaggagatggtaaaaaagaacgcccccatcttggttaaacgggaaaatctgcccaaaacgggaatcgagggaaggaaggctaagatgttatcttatctagaaagaaactcatatataaatctcaccgattacgccggcttgaacaattgtacccgctaccgtgcgagcgaggatatcaagcaatttatcaaggataacgtaatagccagcgtaggatatcgaacacaccggatttatgtgctgcctgaaaaagaagacgggcaaaactaaaacttaagacgcagtggcacttccggactctacaaatacgtgacctaggaaagcgctagataaaccagataagtaacatgatatttttcttcaagaacttcaaggcttcgctgatttggttctcaacggtcttctcggaaatattgagttggaaggctatctctttatagcttttatgctccttccggcttagattaaagataacccggcgtctttccggcaattcctctatcaaatgatcgatatactcccccaagttataggcggtgatctcttcctctaagtcgtaggaggtctccatagcggacaagaccgtcattttataaaagtcctcgttcacgttcttccggtgctgattaaagatcaagttacgggtgatgacaaacagaagccccttgaagttatcatcctcccggatgaattccctcgactcccagaccttgataaacacctcttgtaccacatcctcggccacatcccgattattcaaataaagcccgcagaaatgataaaccttttcccaatattgtttatacaacatcgaaaaagcctccctatctccttctttcaacgactttataatttgtctctcttccatttagcatcacatatcgtttcgcgaagataataaaatcatatactaataaaagttaatgatatcccagttctcccggacttctttgtactattaatatagcacgagaaataatggaagaacaaaacaaatatataagcgatttattaatccgatatgtaaatggactctatacacggaacgatatagagaccttgcggaagttagcctcatccataaccgagcgagcagaattagaaagcgaaatggaccgggtctggaacgaggcgcaagacttacctcaatccgattcccataatcatctgctttataagaaggaggcgcaagacctgttggataagacacgtaaaagagaaagaagaatctccctatccactttcatcaagtatgcggcgagcatagcgattatcgtttccatcggattcggagcgaaactatacctaaatcattcagcgaagcagcatacatctgccagcgaccatctcctaacggaaataagcgtcaatcatggcgaacataagcaagtcacccttcccgatggcacggtcgttcatctaaacgccggtaccgtcatgcgatacccaacggaatttacctctgacatccgtttggtagaaatggaaggagaagcttttttcaatgtcatgagagacgagggcaagcccttcatcgtccgtacccggcaagccgacgtaaaagtactcggaacctctttcaacgtaaaagcctatcaagaggatgagttgatggccgtcagcgttcggaccggaaaagttgaggtggatatgcccgaaagcgtaatgcgcctattaccgaacgagcagataatcgtgaataacacaaatggagagattcttaaaaagaacgaggacgcccaaaaagtaacggcttggctgcaaggcggcctttatttcaaccggacacctattagtagcgttatacatgatctggaacggatgtataatcaagcgatcgtactcgatccgaatagcgtattcgacgattacatctatggcgagcacgacaataaaagtctggaagtcgtactgaacgcgattcaatattcaaccggcatccgataccggacggaaggaaaccggatcgtgttatacaaaacgagttattaaccttaaaatcgatttgccatgaaagatacgacctaagcatagccacataaaaaagggaaaccgacctctgaccttcgatctccctttatctttcccgatatgtacacccttggattggacccccttggagattacataaatcggactgtttttaaaagtgtataaaaacaacctttaaacatacaaaattatgaactttccaactattactaggtataattggatgtgttgttctattattttagtttttttagcgttaagctcccctaagcctctgcaagcccaagaaaatcaaaaagaaagaataacgattcaagtaaaaaaccaacccatacaaaaagtcttcgatgatttgtcgaagcagacaggattaaagtttttctatggagaagccatagcgaaccggaacgtacaagttaacctaaagttcaagaacgctcccatcaacagcgtattgaacgagatcacccggcaagccaatctttattttaagcgagagaataacacgatagccgtcagtctcggaaatgcgggcaacgcctccgttccagtgacacaagaccggaaagtgaccggtatcattacagatgaacagggcgaaccgatcatcggggcgaacgtcgtggtaaaaggtacgtccaaagggacagttaccgacctgaacggtgagtatagcatcgaggcgaacggtaaatcgatcctgctcatatcttacatcggctatttatcggaagaagtggccgtaggcaacaacaagacccttaatatccagctaaaggaagacgcccaaaagcttgacgaggtagtcgtgattggttacggaacacagaaacgaagcaatctttccggagcgatctcgaaagtcacctccgaggttatcgaatctaagcccgtgaccaacgtgctatccgccttgcagggagaaataccggggatggttatccaacgaagctccggccagccgggtaacgaggactttaagatgaacatacgtggagtctcatccgctaacggagacagtgccccgctggttttagtagatggtattcccggtgatatcaatatgatcaatccgcaggatatcgatgccatctccgtcttaaaagatgcctccgcctctatttacggagcacgggccgcaggcggcgttgtcttgattacgaccaagaagggagcgaccggcgcacctaagatcacttacaatggaaacttgtcgatctccaagatgaccggtatgatgaaagcgccaaccaattatgagatggcgatcatggacaacgaggccaatatccataacggctccgcccctatgtatacgcaagagcttctggataggatcttgtccaacgacccgaatccgatcgatcacccgttgtatggaggatggaaattgttctttacgaacacggactggatggacgagctgttgaacaacggcgttcagcataagcacaatctcactatctccggtggcggcgagaaatccaattattatttatccgccggttatagcaagcaattcggagtcgtaaaatatgccgacgacaataacaccaagtataatctacgtatgaactacgattataggatcacggattggttaaagctggaaaccaaagtagccttggacaataataaacgtaccgatgtaggcagcaacggagcgtgggtaatcggtgaggcgattctggatatgcctaaccacccggtctataatgccgatggtaacttcttcacccaaggaggctggagcaatgccgtagcgttggccaaagagagcgagaccgccacgttcaagacccgggagatgaatggtaatttcaggttaatcgccaacattatcgacggactgaccttaaccgcccaagccggtgttaattataagaacaagaacaatgaggacatagcgaaagcgatccctctttatacatgggacaataatatcacctactacaccggagcgggaagtccggagcagtctgccgtggatcgcacgacagaagagaccgtttaccaaaattacacggcctacttgaattacgataagaacttcggcccggaccaccatctggacgccatgttaggtatggcctacgagacggaggaagtccgcatgttcatggcacgccgtgataacttcatctcggatgagctgtgggagcttaacctcggaggcacgggaaatatgaagaacgacgccaaagccgagcattgggctaccggctctaccttcgcccgcctaggctacagctttaagaacaagtacattctggagacaaacttccgttatgacggtagttcccgtttcgcccccggcaacaggtggagaatgtttcccggagtctccgccagctggcgtatctcgcaagaaaacttcttgaaaaactccaaggtattcaatgagctgaagttaagagcatcatacggacagaccggaaaccaagaaggtatccgcctgtatgactatatccagttgctaaagtttagggacgatggctggggaactaaattaatctatccgttcggaaacggttcccaaagccaagccatgggcttagacgtattggccggggtagaccggacatgggaaattctggagaatgtcaacgtgggtgtcgatgccgctttccttgattcccgcctcggcttctcgtttgattatttcgtaaaaatgaataataatatgttaattccggtaacttatcccagcatgttaggcgcggaggcaccctactcgaactcgggtaaattacgcacgaacggcttcgagttgacattgaactggactgacaagatcggcaacgttgaatactctgcccaattccagttgaccgacgccgtgaacaaattagttgaatacggaggtgccgatacctataaactaggattgaacgagacccgggaaggttatcccatgaattcctatttcgcttacgtatacgatggcgtgatcaaggaccaagcggatctcgacgcttataagaaactagagggcgtaccttccaatatcggcatcggagatgcgaagttcaaggatttgaacggcgacggtaagatctccacctacggtgacaaagatggggatgacggcgacgccgaatacgttggctccaccactccccgctattccttcggattgaatctgggcgctaaatggaacaacttcgatatcagcgtattcttccaaggagttgccaagcgcaccttgttccgtgaaggagacttcgccatgccttggagcgactggtggagatacccgccccagttctactacggccagacatggaacgaggatcgcccggacgcctattatccccgcttgacgcatggagagatccggcattggaattatcaggcatccaccctgcaaaagatcaacgccgcctacattcgcctaaagaatatccagataggctacacgctccccaaaggcgcattacagaaactaggcatcgaacggacacgcttttacgtaagcggacaggatctattcgagatacataacgtaaaaggaggatgggaccccgagtcggacaaagccggattcaattatccgttccaacgttattattctttcggtattgacttaactttctaaggttccacgaaaaaacaaattagcagtatgagacgatttaatataattatagcgctatcggccacactcgggctatctagttgcgacttggatatgacacctatggatcaagtgtccgacgccgtattttggcaaaagccttccgatttcgagttggccgccaatgatttctacttcagcctgatggaggcctcccaatatatagataagaactcggatatcgctttcggttcgggggcggacgacgtaagcgatggttcttatttagcaccggtcaattcggatgattgggatgagccttggaaattcatccaatccacttcctatctgctcaagaaagcggaggagtctggattgaccgatgacgagatcggacgctggaaggcggaggcttatttcttccgggcctacaactactggaaactggtcaaattctacggaggggttcccaagatagagattcccttgaatacctcctcggaacagctttacacgcctcgctcctcccagcaggagatcattgattttatcatcgatgatctcgataaggcgattcctttgcttcccaagcaaagccagttgactaccgaggaattgggccgtaccacgcaaggggccgccttagcgttaaaagctcgcgtatccttgtacgagggaacttgggagaaataccatcaaggctccaatgccgatatgtatatccaatcggctatcgatgccgcccaagccttagtggattccaaggaatacgccttgttccgggataaagggaaggaaagctataaatatctacatatcttagagggggatgatagcaaggaggtcttattggcaaggcgttattataaattgagagtgacccataactggacacgggaactttggttcggtgccatggttcctacaaaaaaccttgcggatatgtatttatgtaacgatggtctgcccatcgataaatcccctttatttaagggattccaataccagacgagtgaattcgagaaccgggactcccgtatggagcagacgtttatcgttcccggtagcgagatctttttcgagggaggtctttggacacctacctatccgggatttgtagggaatagcgctacacgcacaggctatatgatccgtaagttcttggatgagacattggatgccgctcaattcatcggcgaatacgacttcaaggagtttcgttacgccgaagtactgctgatcctcgccgaggctttatacgagaagaacggacagatcacggacgagcaattagacctgaccattaatgacctgcgaaaccgggcgaatatgcctcgcttgaccaatgcgtttgtagctacaaacggactgaatatgctggaagagatccggcgtgagagaaccgtggaactggcattcgaaggataccgtagggacgacctacgtcgttggggcacggcggaaacagttcttccccttgcgatccgtggcgtgaaattcgcgggtacggagtatcaacagaaattcccggagttggtgatcggacaggatatacaggtagatagcgaaggctttatcatcgcccaacccgcatccgcccgtaagttccagacaccgaagcattggctgtcaccgatacctttgcaacaggtacaattgtcgaaaggaaccttggaacagaacccgggctggtaagggtttttccaagaataagcgactatatatatgagggtaggcccaacctatacgagaagggagggcctacctatctgggaggggaatcccatttaaatatgaattatcttaaatttttatagcatgaagaaatactttttagcggtagctagtttttttatttattctcatatcagtctaggccaagtgtatccggggcagatggattccacatttgtccctgtacggagtcatcactatgacccggagttaacatttgatttttgcgtaaatgaacccgcttggaacaatcaggcgggtatccattccgcattcggatcgaccgaccggctttatttccggaaggaagtacccgtaaaccataacaacgatttatcatcttcctactctacgaccgtttggaggggggaaagagcgaatgcccagatattggtatggtcgtcagaagcgttggaacaagtacgtgtctctacgcaggacttgaggagcgccgagggaaacatcatcccgaaagaccagattaccttcgagttggtgcgttacgtattgtccaattatccgtatgccgagaaaaaagccatctgcggggaatctccctacaaatccggcttcttgatgccagaccgtttcgagacgctggaccgcttcgatctcccttcccaaaccacccgtccagtatggatgatggtggatgtgccgagaggaaccgttcccggcacgtataaaggacaggtggaggtgcgggcgaaaggcaaggctcctcaactattgaatctggagatcgtggtgcaaaaccagttgctcccctatccgaaagactggaaataccgtctggacctatggcagaacccatgggccgtggcatggtacaatcacgtggaaccgtggtcaccagaacataagatgcttctcaagcagcatttgaagcattatgccgacgcaggtggtacctacatcacgacttatggagtacattctccttggtccgataactcctatatgatcgaggggggcatgatcgagtggatcaagaaagcagacggcacatgggccttcgactacaagatcttcgacgagtacgtagaattagcaatggaatgtggcatcgacgaggcaatcaccctctataccccgattccttggggattccgtcaccgctataaggacgaggctacgggcgattattcttatatcaactgggcgccaagctcagaggaattcaagaagatgtggaatatcttcctcacggatttcaagttccacctggaagctaaaagctggttggacatcacctatatcggaatcaacgagaatccgatggaagagaccttagcggctatcaatgtcgtacgtaaccatgataaatgctggaagatcacttacgccggcaattggcataaggaattggacggactgctggacgattattctttcctttacggagaggaacctaccatcgccgagcaaaaggcacgggccgccaccggacgcacgtccaccgtatacgtatgctgtaacccgccgatcccgaacaacttcgtgttctctcctcctatcgagggacgttggatcagttggtatgtaatggcgtatggttatgacggcttcttgcgatgggcttacgacgcttggccggaagatgccgatcgcgacgcacgtcatggctcttgggcagcaggcgattgctacatggtatatccgggaggcaaaagttgcatccgcttcgagaaaatgagagaaggtatcgtggatttcgagaaggtccgtatcttacgggaactgaccgcccaatcgggtaacgctcaagcccaaggcttattgaagcagctggaccaacatttgtccatcttccccaaagagaaagagttcgatgagaacaagatctcggcggatgtacgtaagggtaacctcatcatccgtcaactgtccgatctattggcgaaataatgggcttacacagcaagaaagacatgaaagcatatcgtttaatcctatcactcatggcaagcgtagccgtagggacagctttctcgcagacaacaggtgttgtttgcgaggagttcgaccagatacagctgacgcacgtattgacgcccaccggcccgttgccgaccgccttggacccgaatggcgtatacccctatatgagttatagcgagacctcaaatcgtccggtacctaaaaggtaccggatgatctcgctagagaacgagaaagtcaaggctatcatctgccccgatctttgcgggaaagtaatatccctcactcacaaggagagcggcaaggaggtcttgtacaggccggacgtaatcaaatacacacggatattaccccgtttctatttcgtggccggggggatcgaggtcagtttcccgatctcccactctcccacgcaaaatgagccggtgctttatcagatcgatcatacgggagaccgcacatatgtaacatgcggagaacgggaatctcattacggtatgcaatggtctgtagaatattccttaggagataaggacgaatgccttacccaaagggttgtttactacaacccgggaaagcaagcctatccatggatgtcatggtccaacgccgcccttccttgcgcaccggatacccaatacgatttcccgaacgggaccgtattatcccatgcctccacgttggacacgatcgactggaaaacggaaggaacccatcatgaacgggatatcaaagagatgaccggctacttctggaaaacgaaagacgtgaatgctttcggggcctacactccctccttgggcagcgggctctatcatatcgccgacgaatccagtacgcccggtatcaagctatggagttatggcgtagccggcgacaaggaatggtccatgctcagtacccccgaccggcagccttacgtagaaatccaaggtggcccgatcagcgaccaatctatcaagctcgaattgcgtcccggcgagaaaaagaatcacgtagaatattggataccgacagatcatcctttggatatctattccttaaaggttccggcattaaggcttcgcccgatcgatcgcatcccgctattcgactgggcccggaagaatgaatcttccatctggatcgccttagccgatgcctataagaataagtccatgcttcccgccgccccctatccggaagacgggcagtgggctccatccggcatggaagatctggacgatgcttttcgttgggcgatccaaatatctccccagccggaacgggattattggcaattccactatgggacttggttggctggaagagaacgtgtagaggaggcgatcgaacaactatccatcccggatatcgatctggcaaaagctttattggcaaggctatatgtccgtcggcaggcgtgggaaaaagcgagagatgcctacgccgctatccccgagacctcgtggctgaacctacatccccagttggttatcgagcgggataaagtattaaagaaatttggaaccgaggctttaccggaacggcaaaaatggctggataagataaacgcatcctctgacgaatgggtggccgagcgaaaggtacagctactgatcgataggaagcaatatcaagaagccaaggatttattgcaatccactcatttccagaaagtgcatcaaacctatacccgtacaggactttgggaacagatcaacgaaggcttgggcctctccccgcaacctgtaccggaacaactcggcgaggatcgtttagcccggtttggtgcctatcgggaatatgaataagggagatgcatttagagcagtagctccatataagtctccgcatatttagccagaaacgcccgaatcactttcaaggccgtagagatatgttgttgtaccgtatataccgagatacccaaactgtcggctatctccttatgggatttcatatctttacggctcatatcaaaaacccttttttgttgtggggtcaacgtttcaagcgccttatccaacaatgcatttaaatccgtatccaataccgagtcctccgtctcgttcgtgctatccaatgaggcggaccgtatcttatccctcagctccaactcacgatccagtcccgccaacaggtttaagatccgatttttcacgatcgtatacacatacgggccaaaaggtacattcgggttcaagaaacggcgattctgccaaatagaggcgaaagcatcctgaaaaacatcttccgccatatcccgggatttaaggaatttcaaggaaaaccacatcaagcgatccttatacagggcatataattcacaaaaggccgactcgtccccttctagcaagtccgccacaagccttctttctttctctgaatcaatgtctgccattcgacttattctcccacttcgattacagaggttcaaatgtatgcaaaattcccaaaggtaaaaacaaattgaaccaaaatcagcaactccatcatacagctttataaactcacgataacaaacatctttgctcattcggaaataatcatgtatttttgtctgttcatttaagaaaggatgatgtattgatgaaagtttgtatcgccgaaaagccgagtgtggcccgggaaatcgcggaagtattaggggcaacccaacgaatgaatgggtatatcgaaggaaacggatatcaggtaacttggacattcgggcatttgtgtaccctgaaagaaccgcatgaatacgcggagaactggaaacgctggagtctggggtcactacctatgatccctccccggttcggtatcaaactaatcgagaatcctacgtatgagcaacaattcaaggtaatcgagagcctgatgcaaaatgccgagatggtcattaactgcggtgatgccggccaagagggagagctgatccaacgctgggtcatgcaaaaggcaggttgtaaatgcccggtctaccgcctttggatctcctcgcttacggaggaggcgatccgggaaggtttccaaaaactcaaagaacagacggaattcaataagttatatgaggccgggctatcccgtgccatcggcgactggttgctggggatgaacgccacccgcctttataccttgcgctacgggcagaaccggcaggtattatcgatcggccgtgtgcaaaccccaacgctcgccttgatcgtaaaccggcaagccgagatcgacaatttcaagccggaaccctattgggaattaaagaccatttacaggaatacgactttctccaccacgaaaggtaagttcacgaagaaagaggaaggcgaggcttttctggagaaggtaaaggaacaggattttactgttaccagtatcaccgagaagaaagggaaggaattcgccccccgcctattcgacttgacctcgttgcaggtggaatgtaataagaaattcgcgtttacggcggacgatacgctaaagttgatccaatcgctctacgagaagaaggtgacaacctacccacgtgtagacacgactttccttagtgatgatatctatccgaaagttcccaataccttgaaagggttggtggattatacggagcttaccgctcctttgatgaatcagaaattgccgaaaagcaagaaagtgtttgacaactcgaaggttaccgatcaccatgcgatcatccctaccggagtccccgcccgcaatcttacggatacggaacggaaggtgtacgatttggtagcccgtcgttttatcgccgccttttatccggattgcgagatatcgaccactacggtcttaggtcaagtggataaggtagaattcaaggtgactggaaagcaaatcctcaaaccgggttggcgtgtcgtattcggagccgagcagaaagatccggaggctgaacccaccgaggaagaaggcgtattgcccgatttcgtgaaaggagaaagtggcccgcataaaccgatcttgaaagagacttggacccagcctccgaaaccttatacggaagctactttattgcgggcgatggaaaccgccggtaaattagtggataatgacgagctgcgggatgccttaaaggaaaacggtatcggccgtccttctacccgtgcggcgatcatcgagactttatttaagcgtaattatatacgaaaggaacgtaagaatctttatcccaccgctaccggtgcggaattgatcggcacgatccatgaggaactgctgaaaagcgcagagttgacggggctttgggaaaagaaactacgccagattgaacgagggacttatgaggcccgtacttttctggatgagttgaagcagatggtaaacgaggtcgtcataaacgtcctttccgaccaaacccggcgaacgattacgattgaggatacgtctaaagcagctaaagaaactcccaaagacgaacccaaggagaaaaaggaaaagaaacctcgtaagcctcgtgccaagaaagagaaagcagaggctactcccgaattggagcttccatcaacggataagcccgtttgccccatctgtcacaaaggctctatcctccggggcaaaaccgcttatggctgctctgaatacaagaatggatgtacgttccgcttggattacgctacgtatggaaataatttaacggatgaggagttaggtacggttatcagtaaattaaagtctatttaaaatatgagaacagaatggtttcctctggtaaacgaggaaggtgagacgatcggaaaggctactcgcaaggaatgtcatagcggaaggaagttgctacatcccgtaatccatttacatatctttaataaggatggagatctatatctccaaaaacgttccatgaacaaggatatacaaccgggaaagtgggacacggccgtaggtgggcatattgattatggagaaagcgtggaagaggccctgcgccgtgaggttcgtgaggaattgggcattactgattttacgcctgtcttcatcaaacgttatatattcgagtcttccatagagaaggaattggtaaacagcttccggaccacttacgatggccccatcacccccgatcccgaggaactggacggaggacgtttctggccgatcgaggagatcaaagagaatctggggaaaggcgcattcaccccgaatttcgaaaaggaattcaccgctattttcctataagataaaacgctacacttcagctaaaatagttattcaagagcctgttcattcttcgtaagatacagttacattctacaaactacggcgtgaaccgtacagaccacagcatggtttgtataattcacgtcgtggtctgtacggttcacgtcgtggtttgtggaatgtaactatatatgattatctttatatatagtaaataagatgttttgtcctatagtaatcgacctattatattataactgtaactccatatgtatcttacctcgaaacctaacaatctttgcctaaagcactaatacctctaccttaaatctaatgtttgttcagaccttaaaactaatcttatatattaatgtgtggtttatacatatcttgcgccgtcaaaccgcattcctttttcatacggatgcaataatcgagcgttcctacctccggcgtgatattgttggaaccgaacgtgaactttacacccgcggctttcgctttctgaatgatcgctttattcggaatatgataaagctcgtttatctccaaagcctttccgctttttgccaaggcattcacgaaacggtcgatacgctcttctgtccaaaacatatcatatcggtcactcatcgcatcgggaaggaaacaggaattcacgtacatatcgaccggctcttccaagacagaacagatacggtccaacatcatatccatatatgcttgctcatcatcgataatcacttccttgtttacccataggtgcgtacgccgccccttatgatccagaaacgtcatggcatcggtaaacacatagtcaaagctgttgcgggccgcctccgaaaaggttgttacccactcacgtccttccgcttgcatagccaagataaagggttgggtacgcatggtatccagataattatacaactccgtatcgttcgtgatcgagaagccgatgccacaattgatagccaagccataattaacacccgtctggcgtgactgccgtgcggctacttccttcgtcaatccaccttttaaatgaacatgataatcaagcacggggaagtcctcttggtgcaaacgaataatctcgtccgtctgctcatccacggcattcgcccattgagcgggaatgtctattcctttcgcgctgaacgcctctaaagagatattcttaaactgaagatttccacgtcccgtacccaccagcgagatagtaccttgggataacaatgctttagcgttctccttcaaacggaaaggtttggaaggctctatatattctacgacagtctcaccattaatccgcacccggacaagccgtccttctacccggatattcatcttgaaccattcgttctctttcacgaaactcttcgtcaggttccggaccgacaccaagctacccgtcatccgccaccaaaccggatcttcccgatcgttgttcaaggcgatacggtatcctttacgatccgtagcgtccgtatggataccaatataacctttgccaccggtcgtggtacgtacatccatatctaactcgaagttcgtatagcctttgccatcgttcaacaaagcacgggcgttggaaccggccaacgtaaagacatcattttgtatgaccacgacgccggatgtcttccatgcgttgtgatcgaccgtatcggatacgttctctttcgtaaatcccgtgaacaccaaacaggcgatcacgacggcaatcattaatttaatcttcatggcatctctttttaaaagttatgccgcaaatgtatccgggaataagaagcaaaaagaagattgatataaaaatgtagacagtatgatccgctatcctattaaatacaaatcagttaataaagatcaccatcctaaaaaatgtagattgattataacggattccggttaatcccgatcctcatcacccaaccttcaaactcatcacgaggcactaacgccttattacgtaccttggtccggtagttatagatcgtactcaacgagcaacgaagaaaagcggctatccttacgctgtccgtaacccccaaccgcatcaaggcgaatatacgaagttccttattcaacagatcctccgatttcaaaacgatacgttcctcgggctgcaacaaagcgttgaagtccttgacaaacgtaggatataatccaagaaagattcgatcgaagttaacataaagcgcttccacctcattctccaccatacgggtcgaacggagcatcttgaataactcgtccaactgtttattcatcgccttcttctgtagcgatttctggtaatcctccagtttattaatataggtggagcagagatcgaggaaatgagcgatgtattcctccttgatatggtttgactccgatagctgtatatttcgctcttgcaataaatcattcgtctcgcttatctctctattcaactttaccaaacgggcattggtattaaccaactcttctcgtatcgctgagatcttccgcatctgcctatacacataggcaagagaaaggatcagaaagagcgtcaataggctgatcgacaagaaataagtcatcaattgccttttgccctgagcttcccgtgtctgataggaagcattaatgataggatagaatttagatatctcattcatgcggaactgtatattgcaagtaacggcaccttctatagctagctgcgcatatttaagggcattggatagatcaccactttcataataattcaacgccagcttttggatagaaccactatccaagaaggccctcttgatatcggcgataaccgacaaggtataatagtctcgggcgagatcggtacgcccatccatatcataaacatctcccagcagataagtgatcatcgcgaaattcgggttataccgctcctctttctccaataaagggatgagcaccttctccgcagacctcgcctgtccgtgagccagatatttctgcgccagatttatcttataccgataagagaccgtatctaagacagacaataacgaatccttgtataaatcaagttgtttcctatattcaaaagaatccagattcgtactgtaataagagaaaaacgaataataagcctcatagaaatcctgtttctgctctttagacagcaattcacggtctatgcttcgcaacagactttccgactcacggtacatcccggagaaagcataaagcgtagccagtcgtaagcgggaagtatagatgcgtgccgtatccttcataaatgacgctatctccatattccgctttatgtaatagatggccgagtcttgttgtattttcttgaattcctcgtataattggtggttgatctcatattcctgccacaacgatatcttgctcaagagaaacatgtcctttagctgcgtgatccgttgctcccgttgctgcagataaaaagatctattcaagacagcttcatccagctccttggccaacgtgtcccctctcagccctccccatgcgaaggcttgaaccatcccgacaattagaaataagattacctttattagtttattcattacacgaaccgagaattatccaaaagaaaagggttcagtcaaatcaacagagcataaatagcttacctcggctgaagactgaacccaatattttaaaacgccccgaaagggtgttatttacacatctcgttgatgatctgtattaattgaccgcctaattcctcggcttcctccatcgtatgggcctcagagtagatacggatgatcggttccgtattgcttttacgcaaatgaacccatttatccgggaaatcgatcttcactccgtcgatatccgtaatatcatattgagagaacttctcttttactttcgctaagatagcgtccacgtcgatctccggcgttaactggactttttgcttggagataaaatacggaggataggaagccttcaactcgctcgtcttcatcttcttctttgccagatgagtcaggaacaaggcgatacctaccaaagcgtcgcgtccgtaatggctggccggatagatcactccaccgttgccctcaccaccgatcacggcattcgtagccttcatcttggcaaccacattcacctcgcctacagcggcggcattatattcgcagccatgagcacgggtaacgtcgcgaagcgcacggctggagctcaggttacttaccgtattacccggagtatggcttaatacgtaatcactgacagcgaccaaggtgtattcctcgttgaacatctcgccattctcgcagataatcgccaaacggtctacgtccggatctactacgaaaccgacatccgctttcgcatgtcccatcaaatcggagatctctgtcaagttttccggaatgggttccggattatgagagaagtttccatgaggagcgcaatgcagcttgaagatttccttcacgcccaacgcatataataaatcagggatcacgataccgcctacggagttcacgcaatcgatagctacacggaaattagcggccttaatagcctccacgtccacgagatccagattcaagacgctctcgatatgtttttgcttataagtcgtattcgggattaccttgcccaaatgatccacgtcggcgaactcgaagtcctcggcagcggcgatacgtaatacctcagccccctcagcggcattcaagaactcacctttctcattcaaaagcttcaaggcattccattgcttcggattatgactggcggtaaggattatacctccgcaagccccttccatagctacggctaactcggttgtcggggtcgtggccagatcgatatccaccacatcaaatcccataccggtaagcgttcctaggacgacttgttttaccatcggaccggagatacgtgcgtcacgccctacaacgatcttattggtctccacttttgtgttttttcggatgaatgtagcataagcggctacaaacttaacaatagctaacggattcaatccgtcttccgggctaccgcctattgtaccgcgaataccggaaatagatttaattagtgtcataagttttcttcaaatatatattctagaatttcgtaataagcaggctcaccgtttgattggtcgttataagtacctcgcttaaacgggactataagttttaccttagcccgatctccgacgtactttaaaggctcttgcaatccttcactcactaaatacggattggcttgactggcataatctccatatgtaaactcccaaggactagttccgttactatggggaccatagttctggatgtaataaggagtactatttatataagcagaatccatcggataggaaacattacatctgtatagaatctttgtcttgtactgaacagctctttggcttgtacccttttcaattatattcagatatgtaccattctccaattcgacaaactgattttccttaaacacactatcctccggaaaatctttcagaatctcaaaatcattctcatcaatcaatcgattgattgcctttttctcatctttcaacatatccgtgtacgactttgtcttgctacaagagatagcaactaatgcggcacacagaatcaacaggatattaaaacctttcttcatttgttagtctttaattgaatgaatcgcaaatgtaaataatcttcgtcaaaccttacgcatgtttgcctaaatcttctgatttattaggattaaattcctgtaaacctttctcaaacacggctacggcctcagataaagagccatagaactcacctccggacgcatttttatgtccacctccgttgaaataagtagaagcaaactgattgcaaggaaaatcgcccacggagcgaagcgatacctttatgtaatcgctgtcctcacgaataaagacactaaagcttacgttctctatgcttaacggcaagttcacgaaaccttccgtatctccagtctggtactgaaaacgatccagttcctctttcgataacgtgataagagccgcctgttgttccggatagaccctcatcttctcatacaacacatatcccatcatacgtaaacgacactcggaatagacctgattcaccttacgatagatcaaatccttatcaatccccttcttgatcaattcgctgacgatcgtataaatctccggtttattcgaattataggtgaacgatcccgtatccgtcatcatacccgtatagatacaagcggcggcatcccgattcaataaatcgaacatccccatacgacaaataaaacggaaaatcatctcactggtagaagacatctccggatacgacatcgtcacacggcaaaaatccgcggggttcaaatgatgatcaatcatcaccttgcggccttctgaggcgatcaccgccggagccagtttctcgatacgtttgggttcattgaaatcgaggcagaaaataacatccgcttccttgatcaatttctcggcgaaatccggatatttctcatgtatcacgacatccttagcgcccggcatccatctataaaaagagggaaatgcattcggtaccactaccgctacattatccttaccgtaagcggataggaaatgatataaaccaagggatgaacctaatgcgtcgccgtctggtgagacatgcgtcacgataacaaaactctcgcctttctctacgtattttttggctttctgaatcttctcttcttgaatgattttagtgatcatataatctttttgttttcacctccaaaggtacgacttttttagtttccggctatcaaaaaaagttcaataaggatctttactgatattattaacaaaagggttaaggcggctaacaaaacttttggttcccgtatcttcatatatatcaagcataaaacaagaaacccataacctcctagcatctcaaagaagctaaaacgacccgtaatcgtcgcataaggcataacgctaaacacgtccactacccttaccatgccatgaaccagcccttctacgatcttctgtatccagtcatatccatagaaatccaccggatagcctaaccacaaaaaggcaaaaggaatcaaaaacatagccaagagagtgaccggtagattcgtaaacaagaaaactgtcgaaaattgtccaaaataataaaaacagagcaaagcagtacctatctgtgcagcaatagacaccgtaatccattcccaaggcatggccaacaaaggatttctcaccactatccattccttgaaacgaggcactaggaataaaataaaaaacacagccaaatagcttaactgaaaaccgacatcaaacagataatacggattataggccagcatacagaaagcggcggcggccaatgtattatatccatccgtaacacgcctaagcgcccttcctgttaaatataaagatagcatcaaggctgcccgtaccgccgagggcgctaatcctgtgataaagacaaacccccaaagacttcccaccagaatgatataacgaatccaacgtcctatcccccatctaggcataaacgagcaaaagaaagataagaatccacaaatcacggcaacatgaaaaccgctcaccgctaatatatgagacacgcccgccaaagagaagcgccttttcgtatcccggctcatcgctttcttatatcccaatgtcaatgtagccaaaatagatttctcctcatcagataaacgcaaacgatcaaatgtatttaccaaagaatattgagccttggtagccaataaatctaaagaagaagcaggctcatttacaagcgctatacgccggtcactataccaacagacctcaaccgccaaacatacaatcaaaacggagactatagctccccatatccaacgggaatcgtattgcaactcagcatgcccttgcccccacgagaaccccaaaaaaagaaaaaccaaagcagataaaacccctaaaacatataggagcgaagaggcaggtaaaaacgcatagcataaaattccggttatccataaaaaaagcggccgtacaaaaggccgcttttgtatttcctcaatcatgatagttaggttttgtgatatattaatgtgttctacaaagctttcaagtctttaattgtttgtatcggatctggagatttgaatacgaagttaccggcgactaacacattggcaccggcgtcaaccaagcgcttccccgtctctaaattcaccccgccatctacctcgatcatagtactcaatcccttccggtctatcatttctcgtaaacgagccaccttatctacggaatgctcaatgaaacgttgaccaccaaatcccggattcacggacatcaataaaaccatatccacatcttggataatatcttctaataagcagatgggcgtatgcggattcaaggtgacacccgctttcatgcccgtttccttaatagccgctaccgtccgatgcaaatgggtacatgcctcataatgcacgttcatcatataggctcccgtagccgccacttcggggataaacttctggggctccacgatcatcaagtgcacatccatcggcttctggcatataggctttaatgcgttaagtaccgggaaaccaaacgagatattcggcacgaataccccatccataatatccagatgcaaccaatcggcgtcacttttatttatcatctccatctccttccgcaaatccagaaaattagcggaaagcagggaaggcgctatcaaatgcttcataatcttgtcttttgtttttacaaaagtacacaaaaaaagaaagagaacctaataatatagattctctttccgtaattcttagttcaacacatacccgcagagctccggacgtacagccggttccgcttgataagccctcgcaaactgtttcaagaaatccatcgtttgcttccgaggcgaacttttcgcctccggggcacttttcacttttttctccaaatcatccatgcattgcgtagaaagcttcctcataggcacctctatttttatcttgtttgctaataaaacgtagggacctaagacttattgcatggaaagaaaattattttacaccatagatagctcgatacggttctcatcggccatacgacgcatattcaagatagcgtaacgcatacgccctaaggccgtattgatgctaacccccgtgatatcggcgatttccttaaaactaaggtcttgatagtaacgcatctccaacacttcacgctggttatccggcaaatgctttaccaatttcttcacgtcagacaatacttgatggcgcacgatattatcctctatcgtaccatcgcaaagcttgatattattaaataagtcgatttctacctcatcattcgagatcgtgttttcgcaacgttcttgacggaaattatcgataatcaagttatgggcaatacgagtaatccatgccttaaacttgccgttctcagtatagcgaccttgttttatagtcatgataaccttcacgaaggtctcttgaaagatatcctccgtaagctctttgttacgtactatgaaataaatgtaagaatgaatgctacttttgtatcgatttaataaaatatcgaaagcggcattattaccttctgcataaaggacaaccaattcctcgtcggtcatcatttttaaagtcttcattactttcacatttttagtttattcgagtaatgtttatgctataggcgatggggttttaactgttatacaatgttatttatggaagcaaaagaacgaaaaatattttaaaccaacaaacattttatttcaaattataaaaagaatgtcccctgcccgcacctttaacgtacgaacaggggactttactgatctaaaatatatgtatattagaacttgtatcccaatgtcaaagctacacgagtcgtgtttgttttcatcgtggcgggttgggcttcgaggaatggtttcggatcatctcccgcaaacatattagagaacgcataaacatcttccttatgcgtacggaatacacaagccaagtccgtatagaagttcggggtgaagcgataaccgatacctaccgtataattcatgacccctttatcgatcgtataattaggaatcgtaccaaccgtaaagacctctttctctccattcttcagtttatccttgatcggactatcgctgtaggcgacacctgctcttacggcaaattgaggagtaacctttacctccgcacctacacggatcgtattcattgacttgaaattatccgttatatcttggttagtatacacgttactgctaccatccgtttgatacatacgcatattcttataattcatcaactcgtaatcaacgcttatcaaagcggtcgtacccaagatagcggcggcactaaagatccatttatccggagaacggaattcatagtcataataagcattattaggggtagcggcatctagtttacgctctttcatctcccctttatccataaaggtcagataagaaccggcctcaccataataacgatctgtcatcttataccacgtaggtgaattataagccacacccaagcgaagaaaatcggcgggacggacgatagcacccacattaaatgaatacccggtaccatccgtatccaagtaattatctaagtataaattattgccgttcgtaaattcctcatcatacgatgactgatatcgatagttcagatccgtaatcgcaaccgtagcgccaagcatcacaagttccgatatatttataccgaaagccaaatcatattgatccacggaacctcgctctgaaacttttaattgacctccttgcaataaatatggactccattgcccatccgcattattatctccgaacgcactataatactctttatcattatcgttatatgaatccatataaccggcattgtatcctagaatagatagccaatcacccaagtcttgattgttataaggattatagtccttatcctcccctaacagtccgctaggcattcctgccgcacgcatggccacataatcagaaagagaagtattcaaatcacctcctgtagccatcgtataattccggctataattcttcaagcgattataagagaaaccaacgttccagctcacgataccctcatcattcgctgtcgggaaatatcctacgtaagcgatattatcgaaactcaccttcgtacggctgttatccaccttcgaaccaagccaatcggtcttcgccgaggccgaagacaaactcaatgtcgtaaccacctccgagcttttataaatcgccaagcctgccgggttcgtattcatagcggaaatatcaccacctaacgcaccaaaagcaccacccattcctaaataacgagccgtaccattcaactccgtctgggaatacttaaaggcatccaactgtgactgcgaaaaagcggtgccgccacacagggcaagcaccgacattataattcctatccttttcatcgtatctctaattttatcaacctaacacttttacctgcgaccaccaccggcacggccacctccgccaccaacagagcctccactagaacgacctccaccgaagctaccggaagaagaacctaccgaactactacgagaaggagaggaacttctaaattgactggaagaagagcgactatttgagaaatcgctactgctcctagaagaggaacgtgttaccggagctgaatattgacgtccggaagaagatgcggctccagaactacttctggaaatccttgttctcgccgagctattacttatgcccgagctacttcttgtcgttgccgaatttctaacagaagaagaggaacgacgtcccgcaccagaggatatagcagattccctacgggtagatcccgcacgtccattgctcaatgaacttgaagacgaaggtcttgtagtcgatcctgaatttctcaaggaagaagagccactgctccgcccacctgtataaccggaacctctgccactcgcataagagcgattatctcgataagaggaacgtccgtttgaataatgtctacttggagtcgagtagtaaccgggatagtaatggtgatgatgtccccaatggccaccccaatagcctccaccccagccccaagacgggccataccatggatcgtaccacggactataatagccggcataaaagcctccccagccccagccgaatccccaagacgggccgtagaagcgagatgaataagtccaccaagggctatagctatagaaccaaggatcgtaccaacctgtataccaaggcgagccccagccgttgccgacattgatattaaaattcacgttcgcgctaccgttcgaataatccgtatcatagccgtaaccataatatccgtcactcagatacaaatcgacttgatccgctccggcgatcgtaatcttactcggcgaatgataacgaatgatacgttccgtatattcagtatccgaacgacgctcggaagaagactcattctcatcgctatcctcatagataacggaatcatcctcacgataaggctcctctacctcgactgatgtataacgacggttatattcatccacatcccggctgtctgaagaagctgggctcttggctgtagcgaccagggccctagactcctgtttcggctgaacaacctttttctcttcaacctgttctttctttttcttgtttttggaagagaaatacacatcatcaaagaactcctcctgagccgcggcactaaacgcgatcagaagcatcatcactaaagatgttaatttcatgggtttcatatttgtttctcctctacattaaataaatatttttctcttttcatgtttgacacccttttatgcaaagggtttaaacgctttttagttttataacaataaactcaatgcaatgtatgtacaaatataatcggttcacgctaatgtcccaagatttacatatactttaacttataaaactcacacattcattgttatctataaaagaagatgcaaagttggcgtaaacgctgcaatctccgcaaattcttattatttttgtttcaaattataacgaaaaaattacgcatatggtattagcctcgacaatagatttcacattgcccttagcggacccggtattaaaatttctcttgattcttttaattatcctggccgctccccttttattaaacaagctgagaatccctcacctgcttggactgatcattgccggcgcaattatcggaccgcacggctttaatctcgtattacgggatagcagcattatcttgtccgggacggcgggattgctttatatcatgtttctcgccggattggaaatcgatatggcggactttaagagaaatagtacgaaaagcctagtattcggcatgtacacattcctcattccgatgatcctaggaacggttgtcggaatatgggtcctgcgattcaacgtattgacctccgttttactcgccagtatgttcgcctcccatacattgatcgcctatccgattatcagcaaactgggtatcagcaaaaacaaagctgtcagtatcaccgtaggaggaacgatgatcactgataccttggcattgctcgtcctaacgatcattgtcggcatggccaccggacaggtcaacgatatgttttggattcgtctgggcgtttccatcttgatattcgcattaatcgtattattcggtttccctttcattgggcgttggttctttaagcatgtacacgataatatatcacagtatatattcgtgctggtgatggtatttctgggatctttcctagctcaggtagcgggtatggaggcgatcatcggggcgttcttatccggactagccctaaatcgccttatcccgcaaagctcacccttgatgaatcgtgtagagttcgtaggaaatgccatattcatcccattcttcttgttgggcgtaggtatgttaatagattatcgtacgttctttaccagtttcgagaccattaaagttgggcttatcatgattatcgtagctacggccgccaaatacatagccgcttggatgacccaaaagactttccatctgtccacggatcagcgaagcgttattttcggcctaagtaacgcacaagccgccgctacattggccgccgtgatggtcggatataacgtaatcaccggaacagacgctaatggggaaccaatccggttattaaatgagagcgtgttgaacggtacgatcctgatgatacttgtcacttgcaccatcgcctctttcgccgcccaaaaaggcgctcataacatagcggcccaagatatatccgataaggaggaaaacaaaaaagaatcagagcatatcttgataccagtcagcaatgaagagaccgtggaagagctggtcaacctcagcttggcgatcaaatctccccaaaacaagaacggctcgtttgccctaaaagtgatagataaccatcattcagacgagaaagcgttaaaacaatcccgcagggttctacagaccgcagtcaatacggctgccgccacggatacccggatgaaagatttattaagatatgacttaagcgtatcgaatgctatcgccagcgtggtaaaagagcgggagatcacagatctggtagtgggattgcacaaggaaaaagatataccggcggccttcctaggccatatcgtggaaagtgtattggcggaaagtagtgtaagtacattcatatacaagcccgcacaacccatctctaccgttagacggcatctgatcatcatcccggaattggccgaaaaagaaatcggtttcaaccaaatcatcttccggttacgaaacgtgacccagaacacaggtgcagcgacagtcttttacggttcggaagcgaccttgaatgccttaaagaaattattagccaagaaaagcggagaagccagttatatcgaattcaacgactgggatgacttcctgatcgttttccgggatataaaaccggacgacacgatgtggattatccttagccgcaaggaaggactttcctacgctcccgccatggcccgtatccccaagtacctcaacaaatacttccaggcaaacagtttcgtattggcatatcccgtgcaggctggcatgaacgagggtactcgctatctgacttaaccattacggaaccagcctctcacgccaagactttcgaggtgagtacggcattttccgcttggcgtatcccagacggaggatcaaggctggaatctcgttggtgaaagacaagtctttcgccagcaaaccggaaagatcacgcacctcacaaggctggttcaaaaaggcgaaagcgatattcttttccgtagctctcaaaagaaaacgttgcaaactccggcctagcgcaaaccattccggtagcgtatttatccgtaaggcgaacaaggctaaatgagaagaagagtccagcttcttcttgtctcccctattttgtatgccggctttcaagacacttcccatgattgtctctgagataagacggggaaggttcggcgccccgaacaccgcataactcaggccgtccgatgtagctcgtacatgattcttattaaaacgcatccatgatttcagctctcgcttaaacagacgatcgttcatttgccggttattccccgcaaatatataagaagaaagcgtatcgaactcccactctcctttcgaccacaaatgcagactgatattttcctccaaaggcgtattcctcaaatagctcagttgatccgatggaatcatttccccggaatatatgcctcgattcgtctgtctcaccgaaatttcctcgataagcccactcgtctccttaatcatcgatgcctccgacaagagtacggtgatctcccccgatcctgaaaaaaacggtagcggagtatatccttttgcctcagccgcaatgcaaagattctcggtggcgcatcctaagctaataaataactcacggttatccggatctacggccggaagggacttactcatatccggaagaatctgtatcctatccttttgcacacgaaacaaccaaggttgggtattatgccccgatggggctttcacggcttgttccatcatatagataaaatccggccgtatatcacttatccgcaatgatcctgtttccatattattatacactttctcattctagcgatgcccgctacctctttccgtttgtgcccggacaaacgcctcaaaaacaaaaaatcccgtaaagctttcgccttacaggactctctgcggaaagacagggattcgaaccccgggaacctctcagttcaacggttttcaagaccgccgcaatcgaccactctgccatctttccaataagtaaatcgtgtgacctgggaggggctcgaaccctcgacccaatgattaagagtcatttgctctaccagctgagctaccaagtcaacatgttatttgtttgagtgacctgggaggggctcgaaccctcgacccaatgattaagagtcatttgctctaccaactgagctaccaagtcattctgtttcgctatcgttactttttcaaaccaccgtttgtttctcgattgcgggtgcaaagatagaggttttatttttccccgcaaacttttcgactactttttttcataaaattttaatcaaactcgtaaatatccgagggtgtagtccgcttcaacgctaccaatgagacatctttccctacccttatgccctcttggaaaagacgtatatccactgtcttataggccagttcgggatggttattgtcccggctgagatggcaaagccagatattcttcaaaccggtattataatgggtcgccaagaactccgcggcctccctattactcaaatgcccggtcgggctcgccacccgctctttcaagaaagcaggatatgtaccgaaacgaagcatctcctcgtcatagttcgcttccaatattaaatggttcgccatgcagatatatttccccaccgtgtccgtgatatggcctacgtcggtagcgaaagtgaatttatgattaccatactcgatatggtaccccacattatcagtactatcgtgaggcacctcgaaagccgtgatacggaaatcacggataaggaatggaacttctttttctataaccttgcgagagacacataaggtctcctccacataccggctcttatcaatcccccggtgcacgtcggctgtcgcatagacaggaatgcaaagcttctcgcccaaatacccgaccgtcttgatatgatccgcatgatcgtgggtaatcaacacggccacgatcttggtaaaatcgatcgaccggtccttcaatactttctttatggtccggattccgatacctgcgtcaatcagcataccgaattccgaagtccccaaataatagcagttcccactgctcccactagctaaactcagaaatgatagtttcatactctcctattccgcaacactgctttttttctgttttacatagtatacactaggggcggaacgtctcagggatcgatacctccccgatcaacgagcagttcatatgctccttcacctcgtcgggtgtcagcccatggccgaagaggaacattagcttcgtcacggcgctctccgtcgtactatcgaagccgctcgtcacgcctgcctccaacaatttgtgccccgtctcataacggtgcatctccacacttccggccctacactgagtaacattcacgataacgataccacggtctacagcctccttcaacatattcaagaaccattcctcgcacggagcatttccgcttccgaatgtttccatcaccacacctttcagacccgggatattcaggatactttccactacttgcggagaaattccggggaatagttttagtatagcgatatttcggtccaacaaataatgcggcttcagcggcttacgcgataccggatgatatacctgcggcagatcatacttgatatagatacccgcatgagccaaagccgggtaattgtacgaacggaacgcattaaaattatctgcatttatcttactcgtacgattccccctcaataaatcattctcaaaaaagatacagacctccgggaccaacggtaagccgttctccttggcagccgctatctcgatcgccgtaatcaagttctccttcccatcggtacgcaacatcccgatcggtaattgcgatcccgtaaggatcaccggcttactcaggttctcgagcataaaactcaatgccgatgccgtatacgacattgtatccgtgccatgcagtaccacgaagccgtcgtatttctgataattatcggcgatgattttcacgatcttcatccacgagtccggccccatctccgaggagtccatcggaggatcaaactgtatcgtggccaccgaataccccagtttcttcaactccggcatattgtccttcaaatgctggaaattaaacgactctaacactccagtctccggattctcgatcatacctatcgtcccacccgtatatatcaacaggatggaagccttttcttgttgagtatgcatgtccatataattatgcaaagttaataaattattcttctcctttcaacaccggaacacttatatgatattttacggcgattatacgtgcgaggaacacgctcaacgccgatacgaactgtatcatcgccgccgacatagaagtttgcatacatatataatatatcaaaccgccaaagacacaagccaacgcataaatatctttccggaatatcaaaggttcctcattaatcaatatatccctcatcataccgccaaacgagccggttatggttcccatcacgatcgccacccacatggggaacccgaaatccaaggtcttggcgatacctaccaccacaaacaaccccaatccgatagcatcgaatataaaaaatgtattgttcaaacggatcacgtattttcggaaagcgataacgaacaacaaagccaaggccgagacaaccaaataagaggcttgttccatccaaaaaggcaccgcgttcaataaaatatcacgaatcgtacctcctcctacagcggtcacgacacccaccacataggcgccaaaccaatcaaattgtttcgcagaagccaatcttatgccacttatggcaaacgcaaaggtccctgtatagtcacaaaaggtgataaaatctatcattttgtttttttcgcaaaaatacggaatagttcgcaaataacagcatttatagaaagaatacctaacaataatttaaaccaaacgaatcccttaatgtttattatatataagtttgcggagtggttataaccgtaacctattgatttttatttacaaaagagaattgaattagatgaggatgaaaaaatgcatgttgatcgggttgatctgtctgctatccagccaatggatgtgggggcaacacttccctcagatggatgcccgcaattacgtgagcgacacggcccttttcattccacgccgcccttggttggcagcaagcgaggtattcggaatgaacatggccgtctggactttcgaccgtttcttaatgaacgaggatttcgcgaagataaacggacatacgattaagcaaaacttcaagacggggcctgtttgggacacggataagttctctaccaatctggtggcccatccctatcacggatcgttatatttcaacgcggcccgtagcaacggactgaatttctggcaatccattccattcgcggcgggaggcagcctaatgtgggaattctttatggaaacggaaccgccctccatcaatgacatgcttgccacctctttcggcggtatagaattaggtgagattacctaccggctctccgacttattcatcgacaaccgctcccacggggcggaacgtgtgggacgggagatcttatccggtttgatatctccgatgcgggcgatcaatcgtatcatcacgggagaagcttggagacacagcagctccaaggggcgtgtctacacctcggttcccgtaaacttcatcgtgggtgttggtcctcgcttccttgccgagcaggaaggctccaagcatggcactacgagcatgcacgtatccttcaggttggattatggagatcctttcaatgatgatttctattcgccctatgaatggtttcagttgaaggccgggttcgatttcttttcgagccagccgctcatcagccaagtcaatgccgttggggctatctgggggaaacaggtctggagtaaaggccctcgtagtctggccgctggaatctttcagcatttcgactactatgattccgagttaaaatccaatagttcccaaacggtagctccctaccgcatatcggaagcggcggcggtcggtggtggattgatctattacaaaagaggcacgccggacaataaggtagatgtttacgccgaattatacggaacaggagtcgccttgggcgcaagcatctccgattacctccggctggaagagagagattataatctgggaagcggttatagcgtgaaagcgtttaccggattggcctacgataaacgctgggcgttcttgatcgatttggagaactaccatatcttcacatggaaaggatacgagccggatatagactggaatgcggtggaccctacaaagttaaacgtacaaggcgatgccggcaacgcacgtttaacggtattttccaccaccttagcctatatgtccaagcataaatggaatattgcgttgcgaaatcgttatttctcccgccgtacccattataagtatcataaagatatagatagctccacgtatgatattatgctgacgcttgggtggaggatttaattcttccgctcaagctcacgcagattctccatcttcttgcgctgcataaactcatagatgccttccaaatgctccgtcactttttggtttccgaactcatagaccttagagaccagcccatccaagaaatcacggtcgtgggatacgacgatcaacgtcccgtcaaagtcaagcaacgcctgcttcaagatatccttcgtcttcatatccagatggtttgtcggctcatccagaatcagcaagttcacaggctccaacaatagcttaatcatggccagacgtgtgcgctcgccaccggaaagcaccttcaccttcttcgccgagttctcgccgccaaacatgaacgcacccagcagatccttgatcttattacggatatcgccttgcgccacatcgtctatcgtctggaaaaccgtaagattctcatccagcagggaggcttggttctgggcgaaataaccgatcatcacgttatgccccagcgtcaacgtcccctcatgctcgatctctttcatgatacacttcaccaaggtagacttaccctcgccattcttcccgacgaaagcgatcttatcccctcgctcgatcatcagattagcgtttcggaaaaccgtatgatcgccatacgctttcgagacattctcgatcgtcaccggataagagcccgaacgaggcgaaggcggaaacttcaagcgcaaagccgaggtatcttcctcatccacctccaagatctccagtttctccagcatcttcacacggctctgcacctgcaaggtcttggagtacgtgcccttgaaacgctcgatgaactctctcgtctcggcgatcatcttctgttgctcgtcataagccttctgttgttgctcacgacgttccttccgtaattgcaagtattggctatagtttaccttataatcataaatccggcccatcgtcacctcgatcgtacgagtcgtgatatgatccacgaacgcacggtcgtggctgatcaccactacggcctgaccgttatcgatcaagaaatcctccaaccactggatagactcgatatccaagtgattcgtcggctcgtccagcaaaaggacatccggtttcttcaacagtagtttcgccagctcgatacgcatacgccagccaccgctgaattcactggtttgccggtcgaaatcctcccgtttgaaacccagtcccaacaaggttttctctatatcggcgtcgtaattgatctcctctatggaatagaatttctcgctcaaggtagagacccgctcgatcagctccatataactatccgactcatagtccgtacgagtctccagttgcttattcaattcggcgatctccgcctccatctcgtgcagatgggcgaaagcctgcgccgtctcctcgaaaacggtacggccatcctccgtcatcaaatgctgcggcaaataagcgatcacggtatctttaggggcggacacttttccacggcttggctcccgcacgccggccaatatcttcaacaaggtagatttaccggcaccgttcttacccatcaaggcgatacgatctttctcgttaatcacaaaagaaacatccgagaaaagggcgcttccaccaaactctactgttagtccgtcaactgaaatcatatgtttattttaatacattaatataatgaagccgcgaagataagaaaaatccctttcattagggatgtacaggagatttcatacgatctttccggggcaagactaggaagaaattggttgccgatgccgtcggcaatattttcgacgccgtcagcaatatttccgacagcgtcagcattattgccgacggtgtcggcaaccaattgcataagggactaatcccttaaactacctttaaaaaaagcagaagcatccacatattttccaacaaaacgcttgttttataaacagaaactcctatctttgcacccgctaatacaaacagcttaaattaattattcaaacatggcaacaaaaattagattgcaaagacacggtcgtaaaggttacgccttctaccaaatcgtgatcgcagacagcagggctccacgtgatggaagatttattgaaaggataggttcttataatccgaacactaatcctgctacagtagatttgaacttcgaaagagctttgtattggttacaagtaggtgctcaacctacagacacaactcgtaacattctttctcgcgaaggcgtttgcttgaaaaagcatttattggaaggtgttaagaagggtgcgttcgacgaagccgcagctgaggagaaattccaagcttggttgaagaacaaacaagcttccgtacaagctatcaaagaaaaagacagcgaagcagctagagcagaagctaaagcacgtcttgaggctgaaaaggaagcgaataaggcaaaagcagaaatcgtagctaaaaagaaagcagaattggcagcagctgaagctgctaagcaagctgaggaagcagccgcagcggctcccgctgaagaagctccggcaactgaaagcgctgaataattcgtgcgatgccaaaataaaaaagaggacatttttcaatgccctctttttttatgccttttccaccagctaccggatcttcctaatgcgtataatcgatcagccggatgccatcgcctaaatcgttctggataacatccttcatccttttggcgaaaggacaggcataacctatcggcgtccctttttggatacaggaagcaaaagcgatactatccgcccctctattcaccaactccctcgcccttaatacggccttttttccgggacaacctccgcaattgataaacccgatgatctcaatatcttcctctacgccctcaaaggctccctttttctcacggatcatcctaaaatcagtagtaccggggcaaaaatcctctgtttgcatacatctgataattcctactttcataaagcatccctcccaattaaaaaagccgtaaaatctaaaattctacggctttccgatctataaatgatgattaactaagtcgtgttacttcttcttcaacaagaaagtatcgatctgtttcacaaactcctcacggggaagagctcccatcgatatctgaggctgtccttccttagggataaacaagaacgtaggaatactttgtataccgaaagcggcagccaactccttttccttatccacatttaccttataaactacgatatcattcttatacaggatagccaaatcccttaaaataggagccacttgcttgcagggaccacaccagtccgcataaaaatcgatgatacaaggcttatcaccttcatatacccatttcgttgcgttcttctcgtaattgaataccttttgcaagaactctgccttgttcaaagtaacgacctctcccttggaggcggtaccagcctcacttgatttatctgatttagcggacatcgagcagcttactaatagcagcacaaccgaaaccagccataaacttttcaactttctcatatagaaaccttttacttgattgataaattatttgctacaaaaatagcaataaaaaggggattcccacacattctattcttaaaagaaaagaataaacaaaaagaaaaaaagcgcataagactcttgtatattccaaaagaatgactacctttgcaaagcaattaaacgaaacgtttgatcgcaaaacatattggaaagatggcagagtggtcgattgcggcggtcttgaaaaccgttgaaccgagaggttcccggggttcgaatccctgtctctccgctgaacgtgctggacagaaatggtcagcaaacggacaaaaagctacaaatcaatgatttgtggctttttttattgcccgaaagtcctgcttccaagacttcaaaagtacggtaaaagacaaagtttcgttactaaatcgttacctattccctgccggacaaaaacggtaacgatttgtccataaatgacctgataatgacttgattagtccatagtctgcataactcaaaaacgagaggtaaaaagtaattttgcaactaaaaaaagtgagttatgaaatcgacattcaaggttcttttttatttgaagaaaggttctgaaaagaaaaacggcgaggttatgattatggcacgtatcaccattgacggcaaacagtgccagttcagtacgaaacagagcatccagcccggtaactggagcattgccgcaggcaaagccaaaggcagggatgccggaagaataaacgccctgctggacgacatacgttcttccctgaacaccatttaccacgaaatgcagcggcgtgacaactacgtgaccgccgagaaagtgaagaacgagtttttgggacacagcgaaagccacgaaacaatcctttcattgttccaaaagcacaatgacgatgtgaagcagcttgtgggcatatccaagacgatagcgacctaccgcaagtatgaagtgacccgccgccacctcgctgaatttatccaaagcaagtacaacgtatcggacatatccataaaggaaattaccccaatgttcattaccgattttgagttgtatttgcgtaccgcctgcaagtgcggttacaacaccaccgccaagttcatgcagttcttcaagcgcatcatcatcattgcccgcaacaacggcatactggtgggtgacccgttcgccagctacaaaatcaggctggaaaaagtggataggggctacttgacggaggacgagataaaaatcatccttaaaaagaaaatggtttccgaacggctggaacacgtcagggacttgttcgtcttttcttgtttctgcggtctggcttacagcgatgtcgccaacttgcggcaggagaatatccaaaagtcctttgacggcaacctttggataatcaccaagcgggtaaagaccaacacggacgtgaatgttcccctgctggatattcccaagatgattttgaagaagtacaagggaaagttgccggacggcaagatacttcccgtaatcagcaatcagaagctaaacgcctacttgaaagagattgccgatatatgcggtattaaaaagaacctgacattccaccttgcccggcacacgttcgccacgaccaccacgctgtcaaagggcgtacccattgaaacggtgtccaagatgctgggacacacaaacatagaaaccacgcaaatttacgcccgcatcaccaacagcaagataggcagcgatatgcaggggcttgacaagaagtttgtcggcatcgagaaaatttacaaggaagtagccatgtgagtttttagttacctatatactgttggtaacagaacaggtaacgatttcggtaacgaaattctacctaacaaactatatcccaataaagtacattctttcaccttgcgggcagtccaccgactacccgcattttttatatccttttccaactggcacattccccgaaacgccagccgtgcgtggcatggctgactgtatttcgtgaaaagagccgttggaaacccgcacaagcgtaccgcaaggtaaacttgccatacccttgcctttcccgcccgcatggagtgttccctaaaagatgaaagagaacaggcacttttcccggtttccctatctgtaaatcttcctcttacgcagtcccccagccgggacagtcgttttaatcatttcaataggcaaaggtagttacgtgttcttcacgattttgcaaggtcgagccgttccggtttggcgaaaaaatcttccctgccttgcgaggtattttttgcccaaaaccttgcaaactctaaacactacccttttgagcctatgtgaaacgaaaacgaccgacccgaccggaagacgcataaaaaaaaagtcggatttacgggaaacaggaaaaaagttcagtgaaacttcaactccctcacctctcaaatccgcataaaattaaaaacttaaaaaattacagcaatatggaagcaaaggtattatcggaagcaaaagtttatgtaggcacttatgccaagtacaacaacggttcattgtccggcgcatggctcgacctttcggactattcggacaaggaagaattttatgaagcctgccgggaacttcacaaggacgaggaagatgcggaatacatgtttcaggactgggagaacgtgccggagggcttaatcgacgaaagctggatttctgaaaacttcttcgccctgcgtgatgcggtggaggatttgagcgacaccgagcaggaagcctttttcgtgtggtgcaactataaaagccatgatttgggcgaggaagatgcggacgaccttgtacgggatttccgggatgaatatcaaggggaatatgacgatgaagaagatttcgcctatgaaattgtagaggaatgttacgacctgccggagttcgcaaagacctatttcgattacaaacagtttgcccgtgacctgttcatgtgcgagtactggtttgatgacggctttgtgttccgtgcggcataacaaccaatccgggcggggtgtcaaagccctgcccgcttaaaacaaccaagtttataaccataaaaaaataagacatcatgcagtcacttaacaaaaacggggtaagcatcacccgaacaccgggagaagaaaaatacgtgaaatgttgcttaggcgcattcaggggacagatttattttcaatatgactaccggcactttgacggcgaacttttcagcacggtagccaaaacgctggacgagtgccgccgcaggcgtgacgaatgggtagcgaagaagaacggagtaataaacaagtaaatttcagggacatgaaaacgacagaagtaaacaaggagcttatcggcaggcgttgcgagtgtatttttacgggcttaatggtaacgggcgttatcgaggacacagaagaaaacgaacacaccatagaggtaaaagtccgtttcgaccacccgcaccagtggggcgatgatttgtataatgatgtgtgggcgtgggggcgcaaaatagacgagttcggcacgctgcaccatttgcaactgttggaggacaaaccggactttcagataatgacggtagttttcggcgagccaatcagccggatagaccgcagtgtttttgcagatgtggaaacgtggggcgtctgttccctgcaaggctgggtaaacagctatgaaagtgtccggtttgtagccatagacgaccatacggcaatcatcacgggcgaatataacatggagcaggtaaaggtgtggttagagaaatacacgtccataaagagccttaaaaccagttgatagaggacggcggctgcttgccgccgttactttcttccatgagcctgccagcgggtgaagaaagtaacaaagaagcctttcgttttccctatcatggaaacagcccgccgatgcttcccggcgggctgtctgcccgatatttacgctttgcgtatcattccatacccggtttcccaagaggatgataaaaacggatgtcgcaactataaatcctcatagtgaataaattttaccccaagtatgcacacggtttcttcttcctcgatgtcatatttccatgtccgtttattgacaagcatttccgtttcgcaatcgaaccataccattacgggcgcatcatcttcttcgtccgcccatttgaaaacctgattggacggcgttttccataattcagcactgtcacgttcggaaatacagtccttgtccacaatgatgatgtcacctactgccggaactgtatctgtttccaacgtggtttctatgtaccacgagataccttctatatccaattctatttttaccatgtcgttttattattagggggttattgtttccgttcctttttcgctgttgtcattattgaacgagaacgaaagttgctgcatctgtccgaagctgtcgataatataaatgtcaatcgtctgctggtctgtcgatgccgaggtgtagtagagccggaatgtttctttctccagcgggtaaaagtcattgggcaggaacaccgtgccgttatccatttccagcttccctttgccgtccggctggaagtaccttatctgataggtagtcggctggtagtagccgccacgcaccagttggcaacgtatttcggcggtttccccgactttcagccttttgggtactggcagcgtttcaatgctgaacgggtacgcctgctgaatatccaagttgtcattacaggcggtgacaagtacaagggcggccacgatgcagcagcccatgatgattttatacattacattcttcatatacattatatataggggttatcaaaataaagtagtcgtttgcctaattcgggcggcaacttccctgacgaccggaacactgaccgcatttccgagcaaggcataacggtgtatcttcgctatctctttcctctctccgtcatatatcccgtatctggtatagttgtcgggaaagccttgcagcctttcgcattccacttccgtaagcatacgtacttgtgaaagctggcttgctgtcagcttgccgttataggtttcgccttttttcaggcacaagacataattcccaatgttgggctgcctgccgtagttccttgttatagttccgcttggacgagcagcgggttcatcactcccgaccttaccatacattccacccggcgccgggaaaggaaatatgtctgcggtacatttctttgcagcacgtccgacaaggtacattcgctcccgattttggggtagaaaccatgccgtattaaacagttgccattcaagtctataaccgccaatgtcggcaaacgctttgacaatgctccaaaaatccgggcgatgtcttgcgaagaatattcccttaacgttctcccatataaaaacgtcaggtctgaaacgcctaacggcttcgactgcatatctgacaaggtggctttctcccccttgcagtccctttccgtccccgattgcgctaaaattttggcaagggcttccgaaagtgacaatgtgtggacgttcgatgccgacttccccgatatttgtaactgttccgatgtgttccgcataaggaaaattgtatttgaagttagcgattgcgtgtttgtctatctctgaaaaatataccttgtcgaaagtatatccggcggcttccagccccttgctgaaaccgccaatgcccgaaaataattccagcagtaccataggctaattgataatgaatttcagtcccaaagatacctgcgtgtggaacttacctatgtccgagccgaacaacgcccgttcccttgcattgacaagcaaggctatccggtctgtcaggtaggcttccagttccagcgtcagcgcaccaccgtaaatgaagcagtccttatccagcaaggtagaaccgtccggcagcagtttttcgcttttgttgctcacctcatacccggcgagagccgacaagcccaatgaaaggaaaaaggtctttcgtctgtccgataggaatttcaggtaatagccgccctctgcggtgaactgttcgactggtattctcatatccttgtagtcatacttcttgtgcaggtattccccgccaatcacccagcggttggcgttcttggtgtaaacgctgtacgccgccccgatgtggtaggcaaaatccgtattggcgttccaatgcaccccgtccgtcatgcccgccgtgacctgcaagcctttcatgcccggcaggtatctttgtgcgtgtgcctgaaacgagatcaggcacagcgcaaagagcatcattataaagatgtgtcttttcattccctatttgattttgagttcgtcaatcacttccgcattcacgatgtcggcgttttccacccgtatggtctgatgccgcccgccgttcttctcgtagagttccacgaccagcagcttgtcgtcaggaatggtaaacttcggcagggcgtacaccgtgcgcacggtcgatttcccggcaatctctatcacctcgttgtagctgcgtaccgcatccagtaccgtttcctgaatagccgtgcgtttgggcactttcttatcggttatcttaaacctgatgaagtccgtgtcgaaaggcacgttggaactgttcttcgtctgcgtgtgtacatagagcatcccgttataggtgtaaatccccttgattaagaactgtatgccgaaacgcttgctacccaagtggcgcactttccggtcattgttcttgtagatgctctgcattatcagcttcaccagcagcgggctttcattgcccagttcccgaaaatagatattcatgcgggtatgcgagaagtcggacgtatcttcattttccaagaagtctttcatttcaatgttgagcatttccggttcacgggcgtacttggcgttgaacgaaaagaaactgccgtcctcgcaaatgacagaaaaattcgtttcgcccggaaagctctctgtggtggctttcacccggataacgttctccgcaccgtccgcctttcccgctatgatgtggttgcttcctaaatccacgtagcggacggcggcggggaagatgatgtgtaccgtcttggcaaaggtcacttccacgccgtagggcgttaccatttgacgataaggcagtttccgggtaatcccctgatacaagtcgttgccagccgcatacttcacggtgtcggtttcctgtgcgtttgccgcacacacgcccagcaagagggcgaacattacaaaaatctgtttcattgctaattgaaattttagtggttaaataattattgttgtttggcgtaaagcatcaccttgtacccggctttcagcttcactttcacggttcggaacttcttggcgaggtagccggacgttccttgcagcaagccccttgtcacgtccatagccacctgctgcccggcactttgggcaaaggatatgcttgtacccagcccgctaccgatgttcgccattgcttcgttgaacgcttcctgttccattgaggacgggacggacagccccttttgcccgtccgtgtcgaacacggcgagttccaccgggatgatgttgcccgcatactcaatggaagacaccagtatgtcgagccgttcgccctgcacttttgccgttccagctacaagggtattcttcggcacaacgatgttccccgcctgcatgggttcaagcagccggagttttactgcttgcccgtccgtcagtgtttggtcttggtggatgcaggcggctaccgtgttctttcccatagcgtagcccgtgcccaccgccgtgttgaaaccgtagttgcgtggctggctgtaagcccggataaagtcggcatcgctcatgggctgctgcaatcccgatacggtcgtttccctgacagcctgcaccgccaccgcatccggcttgcgttcaatgctgccagttacgggtacttgcgccacttgcccgccgttcatgtaccttgccgccagttcataggacttttccaaaagagccatttggtcgtcagcggtaggcgtggcgttctgctgttgttgcagcctgtcggtcagttccgccacctgccgcttcaagtcctctttttcctcgtccaccactggcgtttcgtaaaacgtgcttaactggtggttgatgtcccggtaagcgtttgccgaggaagcaccgccagcccgccggggctgcacatcttcttcttccggtatcaggtctatttccggcttcgtttctccggcttcttcttccgtggtgaaaccgaagtcctgcaacgactgtattttctctttccgtttgcggttcatcatcgcctgctcgtaggctgcctgcttgtcggctataatcccgtcctctgcgggcaggggtatgtcggcgttgaagccgcccacgctctccacattcacgtcctctttttcagcgggtgcgaatatcaggtacatgcaccctgcaaaggcaaggaacatcagcgggaagactatcattttcctgcgctgctgcacctgctgcggggtaagttcccgtttgggcttgtcttcctttttcggcttcccgtccgcctgcggtacggtcgtgccgttctcattcttctgtacttcttccatattgcggtctgtttaacgggttgatatttttggttgtgtcattgccgtgcaacggcagttgcctgatgtgttctatttgcagcctttgcccgtcccgtttcccgatattgtatattgatgaaacggtgatgtagatagacaagccgccgaaaaagaagaacatcacgaggataaccgccagccttttgcccggcgtaatccgtccgcacatccggcgcaggcggtcgtccgcccagtccctcaccttttcgatgtaatttcgttttctctccataaggctatcttttaatggtctgcaaatccttgttctcggtaatggtgaacgcttcgatgatgaagccatgcgggttgttgtcgctccgtgttgcgttaagcaacctgcacgaggtgacaaggcttcgcaccgtcaggctgctttcccggacaatcaactggcgggcatacgtgttcaccttgtaggggtactggtcgaagtcgcacttcacgctgtcaatctccaccgtctgcgtgacgtttccggaaatcacccggttgtagtagcccttttctgccaagtccttgtaatagttgaaagcggtcttgtcggcgagaaacaacgagcgtttgatgttgctttcgatagcccccttttcgggtgataaggtgaagaaaagttcgtggaaacgccgcacgtgcgacttcgcttccacgggtctgttttgtgccatgtcctgcgagagtgccagcatcaggcttttgccgttgtcgaggacgtatatcttctgccgctgcttctcggcgaagctgtacgagttccacacggcaaagcccgtcaccagtgcgcacaggcagatgaataccagcgcaaagagccggatttgccggaaactcgtttcgatgttcgttaatgacttaaattccatatactaaattttgatgttggttatttgagtagtttcccggttactttcccgcttgccgcaccgaccgcagccccggcgattgacccagcccgtgccacgttgcggttataggcagacgtaccgccagccgacactatccagcttgccaccgttggaatggtgaagtagcccacgatgccgataatcataaagattatatacacggtgctgctcccgtccgggatgaaattcgggtctgaaagctgctcgatgtctttttggagcatcagggtttgtatgcgtgccagcacgctgctgaacaagtccgacacgggcagccacaggtaaatggagatatagcgtgaaatccaccgggtcagcgtgctttggaaaccgtcatagacggaaatcgcaaacgccagcggacccagtatgcttaacacgattaggaagaacgtgcgcagcgtgtctataatcagccccgccgcctgaaagagcatttccaataactccctgaaccagtcccggacggacttcttgatgttgtaagccgtcctgtccatgtacatacccgtcatagtcaccatgtcggagggcgaccagcccagttcttccagttgtcggtcaaattcctcgtccgatgcaaggtaagccgtttcggggcttcgcatcagggcttcatattccagtcggtctttctgcgcccggtactcgttcatgtcgaaagtctgcgtttccataagctggttgcacccttttaccactggcgacaataccgtgttgatagtccccagcacgaaagttggaaaaaacatgatgcacagccccaacgcaaagggacgcaggagcgggtacacatctatgggttcggcacgtgcgagcgactgccacactttggcggctacatagaacaaagctcccagcccggctatccctttggctacccctgtcatgttactgcacaagggcatcatttcatcgtacagcacccgcaacacttggtgcaggttgtcaaaatccaccgctgctaataacataggcataccatatttatacgttaccagtagcgttcatccgccgagccgtagagagccagcacccggtcggtgtcgttcttcttcttcgcccgcaggtaggacacggatatgttctttcgggtgtagtagttcacgaggttgcggtagttgagcaggcttttataggcgttgttgattaccgccagcctttcggcatccgtcagcgacatgcccgtcacgttcactacatttttcaagtcctgcaacacgtccgcactttcggagagcagcttggcgtacccggctgaaatggcggtgagttcatccggcgtgtagttcgggtctgccagcatgttctgatagtttcgcacgtagatttcggatatttccgccaccagttcaatggacttcttcaccttgatgccgcccttgacaacatcgtgtaccgctttgagcgcatcgtaatattttttaccctgctggaaaatcttctgcgcttccatgaagccgtccagcgtgttcttggcagtggtggaagtctgcactatctgcttggtggtgttgatgataccctgtgccaagttgccggggtctgacaccacccactgtgcggatgccttgccgatgaagcaaaggcataccgccaaaaggagaattgttttcttcatgttcctaatttttaagttgttgatgattggggattgcgtttgctttccgcaagccgcttgatagccagttcaaggttgccgcccagcttgtcggcgagggcgaacagttccattttctcgctttcctctgtcgtgaacgtgtaatattcttccaatgaaacttcggtagcgtacaccgcagattgtgtgccgcccagcgagaagaaaacttccttgtacttccgtccggggtggttcgccatgttgatagacaatatctgcgaacgctccttatcggtcagccccagcaggttttgtatgctgtcgaacttgttgagatatttcctttggtctaacaatattttgcagtccgagttgttgatgatactctctttcacgataggggaagaaataatatcctcaatctcttgtgtgaccacaatcgcttccccgaaatacttccggactgttttgtagaggtagcgaatataatccgccatgttcgccgatgcaatcgctttccacgcttcctcgattagtattaacttccttattccctttaacttgcgcatcttgtttataaaggcttccatgatgatgatagtcgttaccgggaataaaatcttgtggtctttgatgttatccaactcaaagacaatgaagcgtttatgcagcaaatccagttccttgtcggagttcagcaggtagtcgtactcaccgccacgatagtacggttcaagcacgttcaggaaattgtcaatgtcaaaatccttttccctgacgtttttctgttcaagctgtcggcggtaatcatcccggacaaactcgtagaacgtgttgaagcagggcgttaccgaacggtctttgcctatcagttcgatataggcactcacggcgtttgacaacgccacttcttccgaccgtttcggggcttcatcgtcccgcttccacagggtgagtatcagggtcttgatgctctctttcttctcgatgtcaaataccccgtcctcgacatagaacgggttgaaggctatcgggttctcgttggtgtaggtgaaataaatcccgtcctctccgtgtgtacggttgtggataagctgggacagccccaagtagctgttacccgtatcgaccagcagcacgtgcgccccctgctcgtaatactggcgcaccatgtggttggtgaagaaagacttacccgacccgctcggcccaagtatgaacttgttgcggttggtcgtgatgcctttcttcatgggcaggtctgaaatgtcgatgtgtagcggtcgcccgcttaccctgtccaccattttgatgccgaacggcgaaagcgaacttttgtagttcgtttcttccacgaacaggcatagagcctgccccaagaacgtgtagaaactttcctctgccgggaagtcggcttcgttgccgggtatgcccgcccaaaagagcgtgggcgtatcgaccgtgttgtggcgtggcttgcactccattaaggcaagctggcttcccacatcgttgcgtatgcgtttgagttcgtccctatcgtcactccatgccatgacgttgcagtggcagcgtaccgaaataagccccttgctgtgcgcttcgttcaggtactcgtctatccattccttgttcacttggttggcacgggagtaacgggagagcgattgcatgttccgggcggtctgctcgaagttcttcaggttttcggcgtggtcgtctatgaagatgaactggttatagacgtggttacacgacaacagtacgcccactggggcggcaaaacttaacctgcaatcgcttctgtctgtggacagcttctcaaatcggcagtccgtcccgacctttccgggcaaatcttccacgtccgaaagcgtgtgcaggcacagtatatcgtccccgacacgcatttcttccgggtacagcccgatgtctttcaggcaggtggtatctgtctgcgatagcgagaagtatttctcgatgatgcccgcctttccgtcctgcccggtgatttccgatgccgccagccgggtaagggtgacaaaaccgctgtcgttcataatcctttcaaactgcccgaccgcttcgatgaactttgccgccgcttccttgtcggctatctcctgcggtacaatcctgccccggcatagggtggagaagtcgctctgtcggcggcttctctcccttgtcgtctttgtcaggaacaggtagcagtaatggttcaggaacgggcgttcattgaagtgccgttcaaaggagcggcttaaaaaactaagctcgtccctttcggtgtcgggctggtagttctccttgatgaagaagtcctgcttgtgtactatggagtagtcgggcagcaccttgaccgccttgtaccacgccgaatgtatggcttcgtactcggcactggtgacggtgaacagttcgggcagttccaccctgaaagccaccgtgatgtcggcatcctttgatatgatgcagccgttctccaccgccaaaaggggaaatttcctttccagcgtggtagcctttaacatattcctcatagtctttcttcctttctttttttgtaggtgaataatcggggtatcgcctttcggctgataatgaagcgtggatgccgtttgcgtgcggcggctttcatcagcccgtgcgtgccgtaccgtgcgttgagccggaacgtctgccacacgagcagcagcgaagctgacacgatgaaaccgatacatatccactggttcacgcctgccatgaacaggacgatgaacaccacgaagacggcgagcaagccgccgcaaaagataaagaggtactggcttttcagccccttgaactccaccggctttccgatacccctgtttaccggatatttttcgggcttagccctcaacaactcgtcagacatagccgcctttttagaggaagaacgaacgcaggatagtggcggcgacaatcaggaagatgcacgccccgaaccaactggcggcggtctttgaggtgtcggggtcgccgcttgaaaacttgttatatacttttaccccgccaatcaagccgcagaccgccccgattgcgtacaccagttttgttccggggtcaaaatacccggtgattaggttcgtggcttcggtgatgcccgcctgcccgtttccttgtgcgtaggcacttaccacggcggcaagtatagccgccgacaagaagattttctttctcattgtgatttgtttttaatgccgggcggctggtggatagtccgcctttcccggctggtgaataatttgaaattttagtggtcggggatagtcccgtttgtctgtttggttttcaggttgccaatcaaccgtaatcccgttgtttcatgctgtcaggcttatacattattatattataggaaatcgttcatgtcgaacgcttcgtgttcctcgcttgtatcgccagttccggcagggacagcagccgtagccagttccgcttcgttgcgtcccagcagttccgccacctttgccagcccgccgttgatgttctccaccaccgcatcgtagaggttcgtcccctcaatgcttgccagtgtcccggcggcttgccgtttctccgcttcggtggggttgtcggcgttcgccgtgcgtaccgcttcgcccagttcgtcaaagctcacgcccgtagcccgcccggtatcatcgtcaccgtccatgtacccggctatttcctcgtcctcgtagtcgggttcgtcattctcgtaaccgggcgtttcttccgcttcggctgctgcttccggaatgttttcttccggctgtccgtcagcctgcggcgcaaaaatagtatcattttcagccgcttgcgggaggtgtcccgatttgtcctgctctgtcccgattagtccgcccttgtatcggctttcacctatcagcgtgtagcccgaaacctcgtttcgtgggagtggcgcatcatccgttctgcccggtgatgtccggctgtccgtgtagcgataccacagccacagggcgatatagtacaccaaaagcccggtaagtatgcaatagattaccatagtcagacaggcttttggaagttgctttcgtacagggtgtttatctcgtcttggtactgctcaaagtgccgcagcagaatgttttccacgtagctgcttaccgtcaccttgcgcccgcctatcaccgtcacgatacgcatcagcttctcgtgcgtggtacggctcacgtataagggctgtcggtctgccagttccactttctgaaagtaggtttcccggtagtcgcccgaaccgcccttgcgcttgcggtttgtcgttttctccacccgcaccgtttccgtctgctgttcctcttgggtaacttgtgatgcaagattggtatgtggtgcatcattcggtttattatcttctttactcggtacaccttgcgaaataagttcccgcatgaaatcctcgtctatcttcggcataccgccgctttgctttgccatatcattttaatttgatgtagtacgttatttcggttatcagttcttccaagttgcttccccttaccagcgggcggctggcgggaaagagcgtggagcggaacaccgcctttttatccgccaccagttcctttttgtagcgtttggtatcggggataaaggttttcatcaacggcagttccagttccttaatggtcttgtcgtaggcggtgtaaaggtctgttttctcccgcccgtccaccatgttccaaaagaggtacagcccggcaagtcggcaggcttcattcctcaccaatagcttttggatagccattgcgaacgacaggctgctttccagtaccaccttgtcggctgaaatgggggtgaaaatgtagtccatgcccgcaagggagtttatcacgccctcgctgttcaccgtgccgggcaggtcgaaaaacactatatccggcacgtgtccggcggctatatatccgtcagccgttgcaatcgccttttcaggtgaactgcacaataccgggtaggctttctttcccagccgggtgaactgttcatacgccatgcgcttgtaatcttcatccgccccgacctgctcggcatcccgctttcgcatcccggcaatggagtgttggggatagtcgcaatcgaccaccgccacatcgtagcctttgaggtagtagaggtaactcgccgccagcacggtaaaggtggttttgccgaccccgcccttttgggtggaaaaggcgacataaaggggcgttttctcgttttccatattgcttccgttcattattggttgatagatttatttattgcttccaatcattcattccatattgcaatcttgaaatattgaaagattgttttatttcaatcttgttttcctgctttcattctttcttgaaatattgaaatcctgcaatcacgttttattgaaatcctgctttcaatcattctttcctgattggaatatttctttcaatcttgctttcaatcttgaaatccgatgcaaaaaaagggagaaaaaacgtcccctgaaaaccttgtcccgatttgtcctgcgctgtcccgttttgtccaccaaccacctattttacagcattataaatcaccgttactttgcagcggagtaacgaaccgcaggaggcgcaggtgtaaaaccgggctggtgaacgcagggcttaccgttccacgctaaccccaatccgtccgtgacggatttcgattttcgtcagaaaatagcaaggtgtgttttgtatgctacaaaaccgttttccgtgcctgaaaacgccttgccccttgcgggggtaaaaatcactccgaagtcgtaattttttaattgaaagaagcatggaaacaagaaaacctaacaagggcggtcgccccgccctcgcagacccggcgaagcatcgccatgtcctttacctgaacgaccgggagaatgcccgcttcctctcgcaatgggagcagtcgggcgttacgagcaagtcccgtttcatcgccgcccggctgttcggcgagccgttccgggtggtgaaagtggacaaatcggcagtagaatattgcgcccggctgaccgaattttacgcccagttccgggcggttgcagtcaattacaaccaagtcgtaaaggcgttgcacagcaacttttcggagaaaaaggcactggcttttctctataaactggagaaagcgaccaccgaactggcgatgttgaaccgtcaggttatcgacctgacaaacgagtgcagggaactatggttgccaaaataagcacgggcggcaatatgttcggcgcactggcttacaaccaaaacaaggtggacagcggggaagcaaaggtgcttttctccaaccggatgctgttgggcgaggacgggaatttctctatcggcgagtgtatgcgcagctttgaaatgcagatgcccgtccagctatccaccaagaagccgatacttcatatttccataaacccgcacccggaagacgtgctgaccgaccagcagctttccgacatcgccaaagagtatatgcggaagttgggctatggcgaccagccttatctggtgtacaagcataccgacatcgaccgccaccatatccacatcgtggggttgcgggtggacgagaacggcagaccgctgaatgacaggttcgagcatcggcgcagcaagcaaatcacccgtgaactggaaaagaaatacgggctgcacccggcagagcggaaggaacgtgccgaacgccccgaactgaaaaaggtggactatgccgccggggacgtgaagcaccaagtcggcaacaccgtgaaagcggcttgctatggctaccgcttccagtcgttcggggagtacaaggctttgcttgccgcttacaacgtgtgcgccgaggaagtcaagggcgagataaacggcaagccctatcagggcatagtttattccgccaccaatgacaagggcgaaaagacaggcaacccggtaaaggcttcccgcatcggcaagtcggtaggttatgaagcggtgcagcgcagaatggagaaatcgggcgaagcaatcaggaacgggaaactgaaagagcgcacccggaagattgtagccactgccatgcagaccgcccgcagccgcaaggaactggaacagcagctaaggaagcggggcattgacgtggtattccgtcagaacgacagcgggcgcatctatggcgttacgttcatcgaccacgacagccgggtggtgctgaacggttcacgcttgggcaaggagtattcggcgaacgtgttcaacgaacgtttttcgggcgaaaccggaaagatacaccagtccgaagtggcagcaccgcagcaagaccagcccacgcatcaggaacagccgggcttcacgccgaaatccgacatcgtttcgggcatggcttccgtgctgggtgctttcggcggtttgctgggcggcggtgcatctggcggtgacgagccgcaggacaccgcccgccaaaagagaaagaagaaaaagaagcgcacaaggcgcattgactaacttaaaaacatacaattatgcagcaagaggatgatttgagagggcttgcaagggtcatggactttatgcgggctgtcagtattctattcgtgggaataaacgtgtactggttctgttactccaccctgaaagaatggggagtgacgtttgaagtgatagacaagatactgtggaacttccagcgcaccaccgggctgttctcgtccgtcctttggacgaaactttttgcggtggtgttcctcgccctgtcgtgcatcggcactaagggcgtgaaagaggaaaagataacgtgggcgaagatacattgcagccttgtggcgggtgtcgtgttgtttttcctgaactggtggctgctggaacttccgctgccacatacggcggacactgtgttttatatcgccacgctatcggcgggctatatctgtatgctcatggcgggtacatggatgtcccggttgttgaagaacaacctaatggatgatgtctttaatacagagaacgagagtttcatgcaggaaacaaggcttatcgagaacgagtattcggtaaatctgcctacccggttctactataagaagaaatggaataacggctggataaatgttgtgaacccgttccgtgccagccttgtgttgggtacgccgggcagcggcaaatcgtatgcagtggtaaatagttacataaaacagcaaatcgagaaaggttttgcgctctactgctatgattataagtttcccgatttatcggaaatcacttataatcatttgcttaaccacttggacgggtataaggtaaagcccaaattctacattatcaattttgacgacccacgcaagagccaccgatgcaacccgataaacgccagtttcatgtcggacattgcggatgcctacgaagcaagctacacgataatgcttaacctcaatcgaagttggataagcaagcagggcgacttcttcgtggaaagcccgattatcctgcttgcagccattatttggtacttgcgcatttatcagggcggcaggtattgcacgttcccgcacgccatagagttgttgaacaagaaatacgccgatgttttcacgattttgcgcagttatcccgaactggaaaactatctttccccgttcgtggatgcttgggaaagttcggcagttgaacagttgcaggggcagattgccagtgcgaaaatcccgctttcaaggatgatttcacccgccctttactgggtaatgacgggcgatgatttttcacttgacatcaacaacccgaaagagcctaaaatcttggttgtcggtaacaatcctgaccgccaaaatatctactcggcggcactgggattatataattcccgtatcgtgaagctgataaacaagaaaggtcagcttaaaagttcggtgataatagatgaattaccgactatatattttcgtgggcttgataatttgattgccaccgcccgaagcaacaaggttgcggttctgttgggctttcaggattacagccagcttacccgtgactatggggacaaggaaagccgtgtaatccaaaatacggtgggcaacgtgttcagcggtcaggtagtcggtgaaacggcaaaaatactgtccgagcgtttcggaaaggtgttgcagaaacggcagagcatgacaatcaaccagcgggaaaaatccacctcgataagcacccaaatggacagcctgatacccgccagcaaaatatccaacctcacgcaaggtatgttcgtgggtgctgtggcggacaacttcgatgaacggatagagcagaagattttccactgtgaaatcgtggtggacaatgaaaaggtgaagcgggaaaccgcccgttacgtgaagttgccgcagataatcgacttcaccgacaaggacggcaacgaccggatgcaggaggagatacaagccaactatgaccgcatccgtcaggaagtccggcagattgtcgaggacgagataacccggattaagaacgacccggagctatgccaccttataaaagaggaagaataaccgatattctttcctgacagacagtatttttactaattttgcagacaaagaaatgattatgaatgaaaaccaaaatacggaatggaaagaaagctggcgtgacgagtatctgaaatggatatgcggctttgccaacgccacaggcggcaagatatatataggtatgaatgacaacggtaaggtagtcggcgttgccgatgccgacaaactgctggaggatataccgaacaaagtgcgtgacgtgctgggtatcatcgtggacgtgaacctgctggaagaaaacgggctgaaatatatcgagattgacgtaccgccttattccaatcctatcaattacaaaggtcagtaccactatcgcagcggcagcacgaaacaggagttgaaaggtgcggcgttgaaccgttttatcctgcaacgtactggcaggcattgggacgagtttcccatagagtgggcaggcatagaggaactttcccccggcgcattgaaccgtttccgcaaggaagcggcgagaagcgggcgtgtggacgaagatgtgttgaaagatactaccgaaaatttgctgcacgatttgcggctgattgacacccaaaccaaccgtccgacccgtgccgccttgctgttgttccaccccgacccggaacgctttgtaaccggggcttatatcaagataggtttcttccgggatgataagggtaacttggagtttcaggacgaggttcacggctctttaatggagcaggtggataaggcaatggatttgataaagaccaaatacctgatttatcatatatcatacgagggaatttcccggcgtgaaacaccgcagttcccggtggaagctatcagggagtcactgatgaattgtgtggcacataaagactatgccagtgccgtacccattcagattagcgtgttccccgaccatatcaccttttggaacgccggacagttaccggaaagctggacgaccgaaaaactttttgaaagccacccgtcctctccctataacccgctaatcgccaacgcctttttcagaagcggggatattgaaagctggggacgtggctacaagcgtatcttggaagctgtcagcgcatacaagttgttgccacccaaacttgaaatgttaagcggtctgatgattacctattataccgatatacgttcgcagctattggcgcagcgagtggatgaaaggtatatacccattattgagtatgccgcccaaaatgggagtataaataattcagatgtgcagaatttgttaaataccagtaaaactactgcttatcgaattttgtcgcaactggataactggctggaaatacaaggaacaacaggaaaaggcactcattatacacttaaagggttcacaaagggttcataattgaatgtttttgcttttatgaaatgctgaacttcctgtttaacaagcatttgaaaaccattaaaagggttcacaaagggttcatcgaaagagagtgattgatttcactctcttttttatgcttaatttcgcaaccattggttgaatattttatcttaattgcgtttttcttgttttataatccaagttgaaccgtgtcgtgggaagaatggtctttgccatttctgtttgcaatacggtttgtctgatgtcgcccagtatgtccgccaccacctttctgacacgtggcgggtaacttttcgccaaagatacgattttttccagttccagcaggctatacccgttgaaatattggctcttgacccggttgtagatgtcctgcccggttgttccgggtatgcgcttcatgtcctttatcgcatcgagcagccgcaagtacgggacaaggctttcatccgggtagtccatgcagtaggctttcacgcactctatatccaagttcttgaaacggaaacggcgaaccgggttaggagtggctatcgttatggttgtggctacctgttcggtcagccccattttgttatagacgtaagcacccgtgatatagccgttcagtttttcagtcagatagcggaactgttcatcctgatagacaggcagctttcccagtcccagcactgatttcttgggacgatagtacgcccccttttcaacccgtaccagtacccctttgcggctctgttcggaaagtagcaccgcaacattggcggtcttttccgtttcaaacgacaaatcccggaacgtgaatatacgcccggtatctatccgttcaatctgcccaagtatctctttcctgaatgaagccatatttatgtactttgtttctatgaagcaaagatagtatattatgtaatcacctgaaaaaacataacaaatattttgccgaagatgttttttatttctccaactattggttggatatttttttattcactcggacaaattgggacagtaccggacaaattcggacagtccttgccgcccgtccaaatatagcatatttagtcgctacctttgggcgggactattcccgtaaccactaaaattccaattatttatggcaaacagaatgaccccgcccgcagaggggcaggaaaaagacgtgctgctggtcttggataaacagcagggaaaggtgagtgccgttaagggtatcgacaaggacggcaatttgcagaccgtgccacccactaccggacacggcggcgagttcatgcaggtggacaagaacagcgatgtgttcagcaacttcatttccaacttctaccgcaagtatcaggacacttccgggctggaactgttcagcgtcaaggcttccgaagcggagcgggacgcaaaggcaatcgaggacaaccaccgcaaccctacaccggagggtgacaagcgggctgaaatgcttcgagttccgaagcccgacttccacgagttcaagcagggctaccgcttcgacccgtcaaaaatcgactgggagaacctgaaaaaagtcggcatcaccgccgacaccctgaaaaacacgagggacttcgaccgggtgatgcgtggctacaagtcccgcaacacttacactgtttcggggacggtgggcggcttctatctcaaacctaccgatgtcaagatctctttctatcaggcaaaggacggcacggtagtacccaagctacacggcgtgcagcaggacgaaaaactgttgcaacgcccgttccatgaacacgagttcaccaagcaggaacagggcaacttgcaaggcactggcaacttgggcggcatcgctgaaatcaaagacccgaaaagcggcgagcaaatccccgtgttcgtcagccgggacaggtacacgcacgaactggagtatatgcgggctgacaagtggaaatgccccgatacaatctgtaacgtgcaagtcagcccggaacagaaagccgcctttgaagccgggcaagcggtgaaaatggaaaacctgcaattcagggacggcacgcagcgcagtgcctatttgcaggtcagtgcggtggagcgtggcttggagttcctgccccgtgccgccgtccagttcttgcagcagtggcagcagcccgcagagcggcaggtcgccgggctaaaggacggcaagggcgttgagttcaacggtcatgtacagcccggcgcacagggcaaatcccccgacaaggtgcagccgaaagacgttacccccaccgccgagagccggacgcaggtagcggtcaattcggggggcaagaccaacgaagccaccaagcagggcaaagagccgttgaaacagggtcaggacaagcccaccgccaagcagaaagagaagcaggagaaagcgcaggacaagagcctgaaagctgacaagcccaagaagtccagaggaatgaaaatgtaatatccaccattaaaaagtaaagaattatgattgcattgatagcagagaagcccagcgtggcaaaggacatcgcccgcatcatcggggcgaccgggcgtaatgacggttatctttccggtaacgggtatatggtgacatgggcgttcggccacttaatccagcttgccatgccggaagcctacggcgtggcgaacttccgcagggagagcctgcccatactgccgcccgattttcaattaatcccccgtcaggtgaaagcggagaaaggttacaaggcagaccccggcgtgctgaaacagttgaaagtgataaaggaagtgttcgaccagtgcgaccggattattgtcgccaccgatgccgggcgtgagggtgagttaatcttccgctatatcttccattacctgaactgccggaaaccatttgtgcgcctgtggataagcagccttaccgacaaggcaatccgtgaggggctggataacttgcagccgggagagcgttacgataacctctatttctctgccaagtcccgcagcgaagcggactggctgatagggataaacgccacccaagcgttgagcgttgccgccgggcagggggtgttctcgctgggcagggtgcagacacccacgctcgtgatgatatgcagccgctatttggagaacaagaatttcgtacccgccaagttttggcaactcaaagcggcgactgccagcgggggaataaattttaccgcccaatcgaccgccaagtgggaacagcagcccgaagccatagccgccctgcaacgggtaaaggatgccgggcaacttgtggttaaatccgttgagaggaaagaagcctgccaagaaccgccgcttttgtacgaccttaccacgctgcaaaaggaagcgaacacgaagctgaacttctcggctgacaagacgctttccatagcgcaaagcctgtatgaaaagaaagtgatgtcctacccaagaaccggaagccgctatattccggaggacgttttcgatgaaatgccggaacgtgtcgccctgctggggcaatactcccgctttgccgggtatgccgccgggctggacggcacacccctgaaccgccgcagcgtgaatgacggcaaagtgaccgaccaccacgccttaatcattaccgagaacctgcccggcgaactttccaaagacgagcgggcggtttacgagctggtagccgggcgtatgctggaagccttttcgggcaagtgcgtgaaagacgttaccaccgccttgctgtcagggggagataccgacttcacggtgaaagggtctgtgatgaaagaagccgggtggcgtgccgtgttcggcgagcaggaaacgggcggggatgaagaagccgccagcctgccgccactccaagagggagaatgtttgccactctccggcgtggatctgctcgaaaagcagaccaagccgaaaccgctgcacacggaaagcagcctgttggcggcaatggagaacgcaggcagggaactggaagatgccgaactgaaagccagcctgaaagatgccgggataggcacgcccgccacccgtgcggcgattatcgaaacgctgttcgcccgccagtacatcgtgcgtgagaagaagaaccttgtgcctaccgacaaggggcttgccgtttatgggattgtcaaggacaagaagattgccgatgtcgaaatgacgggcatgtgggaaaccgcccttgccaagatagaagcgggcagcatggatgccgacacgttccggaagggcatcgaggtgtacgcaacgcaaatcaccgcagaactgctatcggtgcagctatctgtcgctactggtgaaacctgcccctgcccgaaatgcggcagcgggcgcatcctgttctacccgaaagtggcgaagtgttccaacgtggactgcacgcttaccatattccgcaacaagtgcgacaaacagctttccgacaagcagattgtcgagctggtgacgaaacacaagaccgggctaatcaagggcttcaagggcaagaacggcaaggctttcgatgcttcgctggtactggacgagcagttcaatgtcggtttttcattccccgaaaagaaagcgaaaccgaagaaatagcctatctttgccgctgaaatttcattgtgataggttttacagcttataataattgaaattttagtggttgcgcccggagggaaaccgggcgcattttttatatgttcccgccaaacaggtaggtcgaacagaccaccccgttatccagcaccctgctttccgagagcttccacagcgagccggatgtttccccgacaaaaccgatgcctttgcccgccatgaccgggacggtgtagattgtcaggctgtccagcagtccggctttaatcaatgaagtaagcagcttgccgccacccaccaccagcatgtcggtttcctgtttcagttcataaaccctttgcagcggttcttcggtcaggaactccaccccgcagtccggtgtaacgttggtgtcgtagtgtgacaccacaaaagaccgtttgcttttgtgcggccacccgccccagtgttcaaagatgtagttgtaggtgttcgcccccataagcaggcagcttgcggcggcgtgttcccttgccgccagttccttgacctcacggggcatccagtccagttcatagtccggcgtggcggtatgcccgtccagcgatacggcgatgtgcgctttgatttgttccatattatcaggtattaaagtgatataaatccctactgtcttggcacgttagccgcaaccccaaaaaagaaagcgtggcatgacgctgtttcgatgcgaggtactggcatacccaaatgtggaaacagtgcagccacgctatgacaaacgcatagcatatcctgcgctgaatatccccacattttgaaaagtgccagttttcgcatcgggacgttcggcgaacgtatatgttatatataaaggcaatattccggcaaccgccgtccaactgccgttacttttccgtgtaacttctgcaaagttaagcaaataccctgaaaaatcacgtgcaaacagaaaaaatcctgccgtgttatcacaacagggcaggacacaagcacctaaaaatacacaagttcagcccatacgcctacgggcagcttgcgttcctttgaagatgatatgaaccgatgacaaaacagctttggttcgccgtgtctttggtgatgatgtccctttcccgcatgaagcggatatagctctttgcggtgcgctccttgatgtccaatacctgctgcaactgctcgcaaaggtctatgtaggtgatgcgtgtctgccgcccgaagatgtcacgtgcgacattcaccagttccctttccttgcgcttctccttttcctcacggggcttctcgcccttgtacacgtgcatccccgcttccttgtcccatgcaaagagcatcaaaggaacgtccaacgggcttccgtcccttactttcaaggctttcacgaccgactgggcgggttcttcgtctttctctatcgaaaggattgtagccgccttacgctgcaactcactacccaaatgtccccgcagtttcaatccgttggggacgaagtgcagcacgcacagaatacacgtgttgtagatacccgccagccgataaagttcatctatcaccgccacgctttccgcttcatcgttggcactcttaacaaggtctgcgatgccgtcaatgacgaccaactggatgccgccgtactggtagtagaacttgtccatgctttgtacaatggcgttcaggcgttctttgcgtgacatgccggtaagacaaaacgctttcagttcatcgggtttgtccggctgtttggcacgtgccagcaggttgcttacattcttgaacagttgcacttccgactgttcggtgtcgtagagcaagaccgccttgtgtttgccgttggcggttatctgtatgcccagcgtatctacttccgcaccagccgggcagatgcagcccgccacgattgcggctatataattgctctttcccgttccctcgcccccggtgatgccgaacaggttgccttgtgtccccagcggaacgtcacccgccgaaataatctcttgcgctttggcgggcgggttgttgaaatctatttcgcatgatttaagcataatcaatgtgtcgctatacaggttgtctaaaaattcgataaacagtttcaggaaatcttcacgggtgttcccggctttgaagtagtcggatatgtccttttcctctttcgttcccggaagcgggagcagcaggcgtttcactccaaattcttccagtagtttttcctgtttgcatgaactttccctgcccgtcttgtccatgtcaaagagcaggacgatgtgcttgaaccggaatgtcagccgataaaccagcgtgggcggtattgtcaccgtttcgctgttgaagcagatagcgtgaaaaccgtgcgccgccagcgaaagcacgtctttctcgccgcccgtgatgaatagcgtgtcgcctttggctggcagttgttccagcccgaaacagtagttctcaccgaagctgccgccgtagaggaaacggggcgtggagaacgggcggtacagcttgatgtgctgtttgcccttgtagccgtacatgggttctgccaccgatgaagtgtaggtgtacggtttgccctctgccgtttcactgttgtattcccggagcgaacagaccttgtaacgttccagcagttcgggcgtgatgccgtactgttgccagtacaccagttcggcaagcgggaacttctgttcccggaactggtagggcttgacgggcttttcgggcgtttcttcgggtttgtccggcactgcccggcagacggttgccgggggaacggaaaccggaatgccggaagccagccccaagcccaaatcccggtcgatgatttccagtatctccacgaagtcagccgcccggttgcagtccagcccctttaactgccccacgaggaagaaacagtcgccgctgtaactgtcgttgccgaagtctttcatcttgtagataccgccccggcggtcgaaatagatgttgcaggaagccttgctgtcctcgtacagcgggttaaggaagttgcgacctatgcgccaattgccgggcaggtagtgtttgaacaccgccagcccgttacttgttctttctaagatttcctctttccttagcatacaactggtggttggttatcaggttgtcgatgttctccttgttgctccttatcaggcgttcttccagcatccggcgtatctcgctgaccttgtagaagtagcgtcccctgatgttggaataggcgatagttcccgacacccgcaggcgttgcagggtcttttcgcttattttcaggaacgtgcagacctcgtagctgtccacccacatgtcttcctcgctttgccttgccgtttccatgtggttgaagatgtagtcggcaatggcggtaatcttgttgtccagttccttgtaggctttggactcgaatgttattatttccataacggtaactgattgatttgccgcaaagttcgggtgtcctgaaaaataaaacgccacagatgtacccacctgtggcgaaataaattttgttaaagcacggttgcctaatcctgctccctcatgcgcatcagcaacctgtctttcagggtggagaggaagcccgttcggtctttggtcttggcttttagttccatgtaggtgtggtagaagtcgccgaggtcgatgtcgaacacgtattcaaagtaggctacaatctccttaatatcaaccgtccccttgttcagacagccgcaggcgtccagtgcgtagataagttccaccaacgcccttttcgtccccgtccagcgcaacacctttcccatgaagccgttcttcacccgcttgcgttgttcccggcgttccagctcgtgcagacggttggtgaggtatatttccagcagttcgttggctaaaatcttggctaccttgaaatcgtgactggtgctgaactgtgggtctgtttcgtaatagaaactgtccacgatgatttgtatgtcaggcttcccacgcatgaaatactgcctgtccaagtaggtggctttcgttcggtggtactggtagaacgccaagttccgctggaacgactttgaaatccggtcggtttccgacagcaggtagtccctttgcacttcctcgctgccgctggggaagcgcacctctatcttgtaaacggtgttgtaatagatgattttgctcgctaaaagcggtttcagttccttgaagaagtgtatttcctcttccgtgctggcgaacgggtaggagattataaagtttttgagttcgcccagtatctcttgcaggtagtccacgcacaggcggcagagcgtcagcgtgtccgctgcggtgtcctcgtattcctgtatctgccattccactttttgaagcagtccggcgaagtatgtttccaacggtatcttatgttccataaccttgtgcttatcttttatgaagcacaaagttacgggcataaaaaatctgttttattcttgatttttcacattacgttcttgtaactgtgcattttcttgtttcctgcgcttttctgcgtatctcgcccggtgtgtccagcaagtaagccttgcagaagtcgttcaggttcgatgtcgatgcgaaccccgtggtgaacgccacttccgtaagcgtgaggttggtgttcttcaggtagtgttccacgtcctttgcacgctcctttatcacccattccttagccgtgtacccggtcattttctttaccttccgtcggaacgagccgtattccatgccgcatttgtccgccagttgctcggcatcatagaccatgtagcctttcagacgcaccatttcggtgaatgtctgcctgcccagctccggcagcatccgttcggcgtggcgcagttccttttccgtcaccagcaggcggttgtcccttaccgggtttctccgtagcaggtggaaagcgtggcataccgtgttgtacacgttgcagaggtactgccgtcccggtcgcatccagtggagcgcatcgcagtaggcggtcagttcgggtatctcgtcccgcttgcggtgctgttccgccagttcgtccagtatggcgtaatgggtggtggacatacccagcaggataatgattgccttgtagtccttgtatgccgccagtgtcggcgtttccggcaggcttttgagcgtgtcgcacacgtgggcgcacagccgcacgtccttgctgaacggttcaagttccaagtagttgtccattttccggctgttgtgcagcagccatgttaccttttcgtccagttccttgcaggacgcttccaactccgcttcgggagcgggaagcaataatgatgtaatccgttgttccatatctgaataaattgatttgttttctgtacgttacccggtagcccatagccaaaacttttggattagccgccaaaccacgtgataaaggaacatggcggcaagcataagaaaacctgcccgcaggaaatattcttcaatgcgctgccaaacgctcgtttttcgttcgggcatcagtatgtccgccacttcctcaaaggtcttgcaggcgaaaatcgcttgccggaactcgtctgcgctgttccagcattcttccttgaaccaccgtgtcttggggtatcgttccgctaccagttcttgcagttttcgtagtgggaacggttcggggttgtccccgtactcgtattcaatggaaatcacacgtccctgcatcctgatacaatatccgaatatcccttgccacttcactttgtgcgcccccttttcaacatatttcgtcccggttgcatccactacaatgtagttcttccgcttcttcaacaactcggtattggtcgttgtgtacagttcttccttgcgaaacacgtatatcatgttgcctttgggggcaaagctgaatatcgggtatttaagtcgggctttcattgtaaatagtctattgttttataaaagcaaaataaaacagggtaacacctaccacaaccccgaaaaagatacaacctgtaataatgaaagcccaatcggggtaatggaaatcaagttcttcataaggaatggcagttttctttatacatctgttccatacccatatcagaacttttccaaatctatttactgtgataaggttactcatattgattaatggtttagcagggaacggcttgtccgttatcctgcttcgttaacatcatattttattctcattccagtgtaccatatcaatacaccataataacaaggtctttttgcgcttcaacggcttcatcgaaaatgaaattcaagtcgtccatttcctgctcgtaatcataatctccgataccgttaccctcttgtagtgaggtgtattccgtccgcttgctctccaaatctgaaacgggtatgctgatgatatagggaaaatcactgctcaatggaatagggatgaatgtactttggctatccaattgccaaaggttttccgcacagtagatttgcgttccataatggttgcaaatcttttcatatacatacccgtacatgaaagcaatttcgggataacggatttctccgttcactatatctgccaacgctgcataagcatctttatccgtgttcaggctatcgctgaaataatcgttcagagtgtcaagttcctgcttcaacgcaacctttaattggtttataagctgattatcacaagttccataaacagactttaccttatcggcttctgtcaaatatgcacaaacagagtaactcataccttttcttcatttaatattgtcattccagtgtaccatgtcgtatggatagtagggcaaccctttcaggctgctatcatccagccccaagaccttgaccaatgcaccgctttcaaaacaccaataaccgtcatggttgataccatatttatggtcgtcatgccaagataaatcagaatgtcctcgataccattcttttttgaggtatttttccaatcgtttcaccgcttctgctttgtcttgttcagccaactctgtaacagtgatagcaattcgatagggtgacggatataatacttggtttgttgtcctttcccaatcaggaaatctgtatctaatcaatgtatcataaatatagtctttagcttctctgtcttttatcagttgcaccagaccatgtataaggtcgtcttcgtaatccaacataatgcctattgacagaagccacaacatttcaatataaaatccgttgtccgtccaaaatctcggcattgttttgagggctttcacataattgtttttcagcttatcaatatcctgtcccatagaatactgtactaataaataacgaagcctataattgaacaaagaatcgtaacctatatgttttcctgaaagatgcatttgttcataataactaatatcttcatcatacattttcagttgcttcaaatactgttcttctgtaaaaagtttatctcttgtttccattatggtacactgctttttgatgttaatggtttgacaaggagctgcgtttagcagctaacttggcttgttatcagtgatttattttgtgatacctgcacatgtaaattttaatcctgtgattgaattttgcttcacaaaatctacaaattcatctgtgcaataataattgttattaaacagactatcccgaaatatgatatatgaaccgatatttcctttattgaaaataccattattatccctcatcatcttcaagatttcttcattgctcttggactctatatttaaggcatcgactgtattcaatacatttataaaataataacctgaagcgttcccgtccacattgacaggtaaaacttctatttgccctttcagcttttcagagagtaataaggaagttcttttatttactatcagacaaccggaaaaataacaagatgcatcaaactcctcacttcgtttgtctttctttttccttttatctctaaacagttccagactaagccctttccactcattaataagtgattgaccattataatcccaaacgcctttatttgactcatcatcttccttgaatacaaagaacttgtaattatcaaagtcttgtccaatttcatatatattcataatgttacactatttaattactgataatggttcagcagggaacggcttgccgttatcctgcgttgttaatggtatatttatattttccctttactataaaaagcctctaaaacaaagagaaacaacgaaaggaaaatgtataatataagtatcaatagattattcttattaggcttttcattaaacttctctatgacagctttataccttcttttccagcagaaacgaatacataaaagaatgaatatcagccctaaagacacattatacattgttcgcgttggataaggcaatattttatattgttccaatactccccatattgtgtgaatattacaattcagaaatacagcgagaattaacaaagctgcataaaccgctatttcggaataagaactgtatttccatagcctataaaatttgaaaaataaataatctatcatacttaattaccattaatggttcggaaatatgcaccgtttaggtgcttcatttccttgttcaaggcagttttacccaccacacactattacatattatatagaacttcaattttagactgctgtttccggcagaaagaggtgtgaagttcatgcctgcaccccgttcgttttattactgctcttatccgtatttcactcattttcagttctcctttctttcgtttcatgggatttttctgtttttgttcacggcaaggcatagctatcccatgttgctgtcatgccgcttttttccggtgtatgtcgcaatgctccagtacaaccgtatatgtgatgtcaccactcattaccgtagtgtggctgtaaactctcatccgtccgcaatgctcgcagaaatactggttctcgtattcactttctgcctgttgcaactcggcttcctttatttcgctttcatcccgtccgaagtattcttccggcaggttgcctttgttggaatagaagccgtagtacctcacgatgcggaaatagcgcagtggaacgtgttgcagcaaccgggggaagaactcccggtaatgcagtgtcagttccttttcaaccgggtttctcctgtcgggcgagttcctgtaatcacggtaacggaatgaaatgttctcaccgtccattgccgtaatcttgtattcactcaggcacgcccgcttggaatacctgcccacatactgtatcacctgctccggcatctgtataggctgctccaaatgtacaatccagtcctttttgttcgccacttttttgatgaagcccataaactccatgcggtcatggaagtcatgctccagcctacccgtgtcgaacaaccctatcagcgcattttcaaacttgtaacggaacaccttacggattgaggggatatgtacataatcacgttcgggaatgacaatctttccgttgctgtcaataccgccccacgacataatcatgtgcgtgtgtacatggagttgtttcgtttccccgtaggtatgcagtacggcaatcaccccggttttcaagccgaacttgtgctgcatccagtccttaacggtttcagccgatgtgcgcatcaagatattcaatatttcttttttgttacgcttcaccaagtccagtaatatatgcggcaaggtcataaccacatggcggtgtggcactcgcagcaacttgtctttcatgcgtgccgcccatttcaacgtgtcacgccagccacatgacgggcagaaacggttcttgcagctatgactgatttcccgtacttcgccacaatcggggcaggcatacgtgtctattcccaaagcggctgtacggcacacacggatagcgttcaccgccttgtactgttcgggggtgatgtactccgccgggtgctgtgcgtactcgtcccaccaccgattgaagaagtcggataaacggtactttttcgctttgcaaccgtctgcatatatgtcgtttaacaaatctgtcatgctcgtgtcgttatttcctttatctttgctaaatccttataagtcgctgatttatagttgttttaattgccttgaatgttatttataaccgcaccttatggtgtcgttcctacacttctataactgcacctcacgaattatccagtgtatcaagaggattagggatttttgctttatgggcacttgacacatgaagataaatggttgtggtcttgatgtcgttgtgtcccagcaattcctgtatcgtgtgcaggtctgttccctgttccagcaagtgtgtggcaaaggagtggcgtagcatgtgtacgtgtacacggtgtttgatgcctgcacgatgtgcggcttctttcagcactttcaccaatgcacttgccgaatattgctctccgggtgtttcgccctcaaacaaccatttttgtggacgatattcccgaaagtagtgccgtagttcttccagcaacttgggcgaaaggagcgaataacggcatttcttccccttgcccatgatacgaaccgacattgtttcactgttgatgtcctgcggggtcaggttaagcaattcgcttcttctaagtccggcagagtaaaccaacgaaatcatgcagtgatgcttgatgttggaaatttgtgcaaggatgcgcttaatttcattcttgctcaacacttcgggcaggctcttgtactctttggcacgggtgataccgccatagtattgccgtttgccgcctttcacctgctcgtaatagaacttgatagcattgatgcgcatattctgttgcgacaccgaaatcttcttctcgttcacaagatagagtatgtacttgttgatgtccggcactttcaggcggtcgatgttccgtcccttgtgatattccatgaaatcgctgaaataagcacggtatgttttgacggtcgaggggctgtaacgcttttgttccagcagttcgagatagcctttcggcagtgtgtattcccttttgggcttgggatgccgcacgtaaacccggctgtaatcaatataggcgtggggcgaatagcggtcgtaaaaatccggcaggctgaaagcggctgacgctatgtatgcagagccgttaccagccatttccatgcccgtgtcttgggcgagcagcagggcgacagcctgactgttcgcatattctatccgtatgtaatccgcaccgtcccttgtttctttgtgtagcacgatgcttcctctttgtttctgaaccttatccatgtcgctgaattttgcttcgctccaaagataagataaaaataccattatttgaacatctgttcaaaaataatcgaggttaaaaaaacaaaagagtatcaggctttaagcagcgaatagatatggcgaaaattttctgccagttcgtccacgttcaaaccgtttagaaatgcttgttcgtatgacagccctaaaaacatttgccggaacatgatagccgttttcttcacgtccgtgttgctcctgatttccccgctttcttttgccttctgtatgactttctcccataggtcatagtcttgtcggtagattttctcaattttctgcctgatgcccggatagtacatacgcacttgtgacagaaagtgaaagtagtagaagttaggactacaatcatgcgggctactattatcaccaatcagttcaacaatccttttcatggaagcggctacccccgccacgtattgcccgatgaactccgccaacgtatcggcaggagcggcaaacttgttttccggttcgtgcatttgcaacacgtatttgtccgccacagccatgaataaatccagcttgtgcggaaaataataaacgatacccgtttttgtcaccccgcaggctttggcaagcgtgatgatgcttgctttctcgtagttcatcctgacaaatacgccgaacgctttatctattacttcttcacggttagttattatcatacacgtttgtttttaatcggttacgaagatacggattttgttttaagcatttgtaccccagtgcttttttttagtgcaaggtgcaagtatatatttatatatatagcttgcaccttgcactaatcgcagaatatttattatcaatgatttgcgtatttcaaaagaaagacttatctttgaacccgaaagttaggcagacaaacagaggtcaaagttggacaagcccaacgtctgaaaatcgttactgtttcgttacctatttgaaattttgaaagcaaagtagctgaaatataagcagttagagttataggttcaaaaccctgtctttccgcagaacctactgaacaaaacaagagagtaagtggacaaaaacctacaaatcgctgatttgtaggttttttattgcctataagtcttgtgtccaatgccttatcagaagaaaattcggctcacctgataatcagtgggggtatcttcaggctcatctatatttcagccggcaacctaagacaagtcgacctacagaaatatagaagtcggccaacagatgagatcatgggataaccattgccatataaatcgctgtcttatatcctgttaatcaacaggccaactcacttgagaaaggcttcccaagtgaataactaaccacttccagactcgtaagcttacggctacccccagccgtaagttattcacttgacaagccgtaagttattcacctgacaaggcataaattatacattaaccgtctctcccccgatggttatcgggaaatggcagaggaactatagatacaagtgccccatttgtctttttgacaacttgtaatctgaagtcccggagaaacgattattccgtacccaagtgcgtctcgcttccaaattcgagagaaaaaaacagcaattctctgtttgatagctgtttgctgaaaaacggcctttcgttccagccgaaataattcaccctagttcatgttttacggtcgtaaggcggtaataatgcccaacgctaccgcatgtgagggccgatacctatatatgtgtaggcttacgccactatatgtgttgcttgacgcgactatatgtgtgggttaacactgctatatgtgtgagctgatacagccatatgtgtaggttgatacgtatatattcgttaaaaagcgacgcttatcgtgttaaaaagcggtggtggcagcttgttcgcgctccccgtttacgcccgttggcttttatagccagagagccgtgtcgtgaaaaagaaggcatttcaatcaaaaagataccattcatcgcattaagctgacatccgcgattcttgtcttatccctttgaattaagtctgtccccaataaatatcgggtgagccaagtaatcgcatccagacattgcatctctatgtaaattcgcaagcgaaactcttgcataatcaaaaaaaatcaatacctttgcacccggtttcaacaagaccttggagagatgctcgagtggttgaagaggcacgcctggaaagcgtgtaaacccctaaagggtttcgcgggttcgaatcccgctctctccgcagaactaaccagataatgaacagtcaagtcccacaaatccaacgatttgtgggactttttagattttttgttacctacactaaatcttcttgtttgatcgaataacacttagtgtttgtaagatgacagacaatattattacccctagccctatataaaaagcggcgttcaactctttagcctcactaaaaagaagcatagccaagataatgctataaataggttccagattataactcaagtttaccgtgaacgcagagatctttttcaagacttgtatctgaagtaaatacaaaccaatcgtacaaacagaagctaaaagcaataaataagtaaaatctaatagcccgggaacaatcgtcgatacaggaatatatcgcaaatagaacggtaaaatacaggaaagcccgataaagccacctaccatttcatacaagagcatggtacttgttgaataattatttccgatcttcttattcgtgatcgtgaacaaagccgctaaagcggatgatataatacccaaacctattcctaaacgatagcgagtatcgaaatggaaaatcagtaccaccccaaataaagtcaacaaactaaaaacaacctccttgaaagacactctatgacaattaatcaatggctctagaaaagccgtaaagaaacctaccagagaaaaacaaaccactccaatagacacattcgaagcctttatactcccataaaagaaaacccaatgcaatcccagcaataaccctactccccctattctcaaggcatccccgaaagaaattcgattcaatcttttgctgacggataaaacgagtaaaaacaacaaagacgcaagcatcatacgataccagaccaatagggcttcattcaagctaatcaattttccaaatatgcccgtcgcacctgccaaaataatagatatatgcagttttataaatgcgtctttcattatgtcactataatatttaattatggacaaatgtataaaggaaatataagctatcgaattcaaacttgataaatactccgttttttaccctaatggtaacttttttctaaatggagaagcctacttttgtgccgcaaaaataaaaagaaaagaaactgatgatgcaagacagtattgattttggaacaatgaacattccgaagttgttccgtatgatgtttatccctaccttattaggtatgatcctttccgccactattaatatcgccgatggaatattcgtaggaagaggcgtaggaaatgacgccttggctgcggtaaatatcgtggctccttttttcatgttagcaaccggaatcgggcttatgttcggagtaggcgcttctatcgtcgcctcgatccacctttcacaccagaaagtcaaggtagcgaatattaatatcacgcaagcgctttcgatctcattatgtattatgttatcgctttccttgttagtgatgacattccgtgctgaggtcgctcttttattgggtagttccgagcaattattgccctccgtattggaatatatgaactggatcgtcccgttccttgccttttacatgttattgaatatcgggttattcattatccggttagacggatcacctacatacgccatgttatgcagcgctatcccggccctgataaacctaacattagactatattttcgttttcccattgcattggggattaatgggagccgctttagcttccgctatttccgtaatcgtaggaagtattatgatcgtggtttatatcgtaggtttttctaaagtattacatctttaccgccctaaattctcgcttaaaagtatcttattgacaatccgcaatatcggatacatggtaaagcttggttcttccgcgttcttaactgaggcagctatcgcttgtatgatgctggtgggtaattatatattcatgagataccttggggaagacggggttgccgcctacagtgtagcctgttattgctttcctatcgtattcatggtgaacaatgcgatcgcccagtctaccccgccgatcataagctacaactatggcatacagcagtggaaaagagtacggcaggcgtttaagttagccctgctatgcgctgtcgtgtgcggaggactcgcctgcgtgggtactattttattctgcccggaagtctcctccttatttctcggtaatcatggcaacgcttacgagatagcggtctccggcattccctatttttctttgggatatgtctttttcgctctcaatatcgtttgtatcgggtactaccagagcatagaacgtttcaaacccgctacgctattcactattctacgaggaatcgtgattatcaccctaagtttcatgtacctacctgttgtctgcggaattaaaggtatttggctggccgtacctttgtcggaattaattacttttgtaatcattgtggtatactatctattgaaacgtacaagagcatgaaagaggaagttcgccagaaagtgatggaacggttttcaatctctgagcaggccatgcggttattgctggaaagcgcagagatgatgtcgtttgtccccaaagatataatcgtacatgaaggtgagataaacacgaatatgtatatcttatccaagggaatctggcgggcttatacatttaaagatgggacggaagataccttttggttcgccgtggagagcgagatcgcactcccggtatggggatatacttccggctctccttctctttataccatagaagccgttacggaaagcgaggcgtattgcctatccaaacagaaactagaaatcctatttcaatcctccgtgcaattagcaaatatcggaagaaggattctagagaattttatgcttgagatcgagacttcatggttaagttcttacaaacgaaccgccattgaacgttacgccattctattggacaagcagcccgaaatcatccaatccgtccccctaaaatatatagcttcttatctaggtgtcacggctcaatccttaagtagaatccgggcgaaattagctagttctttaacctttatcgtgtaaagcctcttcatttttataacgcatcgataaccaacctctgacttttcataaagtcaatacgttaaatccgtaaataacgatcaataatctcataataactttctatcgcattagcggatcggagcaagttcatatcgaaagtcactctattatacaagtgatttcctatgatctgatcccaacttacaggaaatttgcgcaacctcatcaatcgtaaaagcgacctccccacgaagcctgcggtacaccgcctctctcccgatacataaagtatccgtcaagaaattagcaagattttgtccgggaggaagcctatctttcattgcggttatcaattcatttacaatactatctttcattgccttataccttatttccaactattaatattccttaatacatttggcaaatgtaaaacatgtaaacgatagttttgtacgataaagcaagcctatgagaattgttccttttctaattaaagcaaacacagacagaaaaagatagaaaacgaaattaaactaaaaaagcacctataaatttcgaatcgcgcaatcggaagatctaggttgtttcatttatcgaaacaggttcaaaccctaaagcgtatttataatctccctttgtctattgaaaaactggatacgttgcatctctccactctcggagatcatggtagagaacttttttaaagattgaatccagtctttcaagctattaaacatctcagtatcctgtgtcgtaatagaatttatcgagtaaacccgtatcatacttaactgcaaagaacttgtttccagataactatacgtagcctcaaagttaatatgcgatacataaattcgtacactattgccagcctcggtctttcctctcatggcaagttcttccaattcatccaccaacactaataactcctctttgatacgttgtatatcctcacaggaaataagatggatatcggagaaatatttaatgtcattgaccaaatgatggaagatcatattatcccaaatataatccgtagaatggatatactgtgtcaacgatacaaattctctttgggtatcaaccagtttttccggcatcttcagattctcaaaatgattgcattggatatgcttattctgatacatccacttaaataaacgaaactttgacaaaaggtcatgcttcaaataaagggtctgaggaatagtattggaagaggtacccaaagccgtagtaggatcatcctgaaaggccctaaagatcttcacatatctagacaagatcgtaaaataagcattaaaaggatcatcgtgatctaccacattcaagtcgaacacggcattggcactaaaactaacccctactattttatccaatgacacacccaatttccttgagataagagctgcctcttccaaggtgaaaggaacctcgccacgtaagcgcctataaatggcttctctgccaatacaaagggtatccatcaacagattcgccaaatttgtcttagggggaagtttttcttttaaagcttcaatcaagcctgtatttaattcatttatcatcataaccatgtcgaatgaaaaatcatctactctagtaacatatatagagaggaagttgtttcgagaacaagtacattcgtagatggattttcaaagcacgtagcttttcagcttattcatatcaactattttcccttcccgggaaatagccccttcctctatcatttccgagaaactacgggccaatgaaggacgggccactccaaaatattccgaaagctctgtttgattacgatcctgcttataatggtctccttgaatacgtttaagtatatagtaagccagtttacctttaatggtcttaatcgataataattgaagacgttcagaaagaaattgtgttcggttggcgttaaaagccatatagctttgaagaaaatgctcgtttgtcgccagcaaacgcatcaccgcactcttaggtattaaaatgatctcgcattcctccaaggcgataacatctaccgggaagcgattattttccgcaaacaaaaatgcggaggccaaaggagtaggcgccgataaagtctccacttccagaattgtcccgctttcggtgatcatctcagtctttacccgtcctttactcaatagataaagcgaagataaggcatctccctgacgagccacccagtcacctttcttaaacgaccttgtcgaataatccaacgaactgaaaagagcggtttgctcttcctcagacaattttccgcaaataggacacaagctcaggttcataaaacttccttttgcggataaagataaagaaaataatcaaagagtgtaacaactgttacagattaaacgaccttctcccccctacattcgcgataaactttaaaaataaaagctatgttctgttatcaatgtcaagaaaccgcccaaggaaagggctgcacattaaaaggtgtatgtggtaagaccgccgaagtggccggattacaagatttactgatgtacttaatgaagggaatctccaaattaacaacgactttacgcaaacaaggcgtggaatcatccacggccaataagtttatcgtagacggacttttcatgaccatcacaaacgccaatttcgattcatccaggttcgtctcaaagatcaaggaagcctatcagctacgggagaaccttctcaacgaattgcatcgactgggaatccatctttccttaacctgcgactgtctgacttggaaatcggataaagtagaggaaatggaggtcaaagcgaaagaagtaggtattcttgccacagaaaacgaggatatccgttctctatgcgaattactcacttatggggttaaaggtatggccgcctacgtggagcacgcttacaacctaggtttcgaggataccagcctctatgcctttatgcaagatgccttggtaacgacgactcgatcagacctgactgtcgccgatttaacccaatgggtacttacctgcggcgaatacggagtaaaagccatggccttattagataaagcgaatacttccacctatggcaacccggaaattacgaaagtgaatatcggcgtaggaaagaacccgggtatacttatcagtgggcacgacttgagagacattcaagacttgctggaacaaaccgaaggtacaggcatagatgtctatacacatagcgagatgcttcccgcacattattacccggctttcaagaagtataagcattttgtaggaaactacggtagcgcctggtggaaacaaacatccgatttcgagacattcaatggagttatcctgtttacgaccaactgccttgtccctccccgttcttccgccacttatgccgatcgggtctatacgaccggctctaccgggttcgaaggattcccacatatcgccgatcgtaagcccggaggctctaaggatttctctgcgttaatcgaacacgcaaagaaatgcgcccctccaacggaaatcgaacacggggaaatcatcggtggattcgctcatgagcaggtattccaattagccgacaaggttatcgatgccgtaaaatcaggagcgatacgtaaattctttgtcatggcaggttgcgacggaagaatgaagagccgtagctactataccgaattcgccgagaaattaccgaaagataccgtcatattaaccgccggttgtgccaaatatcgttacaacaaactgcctttgggtgagatcagaggtattccacgggtattagatgccggacaatgtaatgacagttactcattggtgatgatcgccctcaagttaaaagagatcttcgggctggatgatgtcaatgaattacctatcgcatacaatatcgcatggtacgagcaaaaagcggtaatcgtattactcgccctactctacctaggcgtaaaaaacattcacttaggaccgacattgccagcgttcttgtcgccgaatgtagccaaagtattggtcgataatttcgggatcgccggaataggtagtgtagacgaagacatggaactatttctaggaaagtaaaataaacctttaccgatccgctcttgttttcctatcacattttaatcgattcaagatgaataaggaacaacaaaaaagagtagccgccattcatgacctatcgggattcggcaaatgttcattgacagttgccctcccgatcctctcggcggcaggaatagagacaagcgccttacctacggccatactttctacacacacaggaggtattctcggctatacatatagagacttgacggaagatatgcgtccgttcatgaagcattggaaagaattagatatccgtttcgatgccgtctacagcggctttcttggatctttcgagcaattagatatcgtaaaagagttcttctccctttttaagcgggaagataacctgattctagtcgatcctgtcatgggcgataacggagaactgtacaagatattcacccctaaattcgccaaaggaatgagatccctttgtgaaagagcggatatcatcgtaccgaacctgacggaggccgcattattgttgggcgaaccctaccaagcaggtccctataccaaagcttatatcgatggtattttacataagctaagtcagctaggccctaagcaagttgtcttgaccggtgtctatttcgacgagaaagaactgggagccgccactttcgatatggaacgaaatgcgacagagtatgttttaacagagaaaatacccggttattatcatggtacgggagatgttttcgcaagtgctttactgtccggtttgttaaataatttcaacttggagagatctgcggaaatagccgttcgcttcacggcagaaagtattcttcgaacattcaaggcgcaaacggattatcgctttggcgtgaacttcgaacaatccattccggatttactaaaagaactgaaactgatataaatgagagccttttttttctcatatttgcaaataataaggaatataatagtatggctaaattaagaatagcgttttctggtatcggtgcggtgggtggttattacggaggtatggtcgccgcccgctatcaaggaacaataaaagcagatatcttttttatcgcccgtggagaaaatctaaaggctatccgtgaaaaaggtttacaaatgcaactaggcatccggacaatccatacggctccggcactagccaccgataatcccgccgagatagggccggtagactaccttttctgttgtacaaaaagttacgatctagaagaaaacatccagcagctaaagcctgttatcggacctgagaccgttatcatccccttgctaaacggattggatatcgaagaacgaatccataatatactacccggacaagaggtctggaaaggatgtgtttatatcggttcccgcttgacagagccgggtgttgtcgagaaattctccttgaaggaacgtattttcttcggcaacaaagatgcaaacaaagataagcaaaccgagttgcttaaattacttatgtatgcccggttaaacgcttttaatccagcggatatagacctacgcatctggaagaaattcttcatgatctctacggcggctacggctacgagtttcttcaaccagcccattgatgaagtactagcccaacatattgatctattcatcgctttgggtacggaattaaaaagcgtagcggaggctatgggagtctgtttacccgatgacatcgtctatacttccatcgagacgcaaaagatgatgccggccggctccacgacttccatgcatagtgattttctcgccgggaaaaaaacagagttggaaacattgaccggatatgttattcgtcaagcggagaagctcggcgttgatgtccctacttatcgatttatgtataacggattgtctttttatccctatccgaaaaatcagtaatatcatacattatggaagatctaataaacgggcgttgcggttggtgcggaactgacgagttgtatatggcgtaccacgatcaagagtggggaaagttggtgactgacgataaaacactgttcgagtttcttgtattggaaagctctcaagccggattgagttggataacaatccttcggaagcgtgagggatatcgtaaggctttttgtgacttcgacaccgaacgggtagcgcaaatgaccgatgaggatgttgaacggttgatgcggtttgagggtatcgtgaaaaaccgccagaaaatcaaatccacaatcacaaacgcaaggctgttcctcgccatacaaaaggagttcggcagcttttacaattacaccctgtcattctttcccgacagaaaaccgattatcaacacattccggtcattgagcgagatccctgtcacgtcgcctgaatccgaagccatgagcaaggacatgaagaagaggggcttcaaattcttcggacctacaatttgttacgcccacctacaggcttcgggatttatcaatgatcatctgatagactgcgtttgcaggaaaggataataaaaaggggatgtgtcaaaagtccggtttattagatttgacacaccccctcattattatttagcgcatcgatcttattgaccgatataagtctccatgaacttagcgcccggagccggagagatggttattacctccgtgtccgcagggatcaagacagtttgaccttggtgtacaaagatctcgtttcctttattatcacggatggaagccttgcctgccatacagatataaacgacaaaagaatccagttccgagaaattacgaaccataatcgtatccagatccaaaaggtttgtcgtgaaatacttacagtccgccaactctaccgtggcattcgtatgacctttgtagtgagtacggtaatccggatacaacgtataatcgatcgcgtctttcgccaattccgtatgcagctcacggccattaccgttcgcatctttacggttgtaatcgtaaatacgatacgtgatattactagtctgctggatctctgcgataaaacaacccgctccgatcgcatgcacacgtcccgccggcaagaaaaatacatcaccttcatttacgtcgtaacgttgaagcacatccatgatcgtattgttctccacccgtttcacgtattcctctgcgtcgatttgctcagagaaaccggaatataggccagcgcctttctccgccttgatcacataccacatctccgtcttaccgaaagagttgtggcgctttttcgccagctcatcgtccgggtgaacttgaatagataaattatcacgggcatcgataaacttgattagcaacgggaaagtcgtcccgaatctctccatcaccttctctcccagcaactccttgccataagagcggatcaactcatccaaagacttgccttccaactcgccattatcgacaatagaataatttccctcaacatgagaaagctcccagctctcgcctacaccattctcaaccggagtaatacccttaaacgggcagatatctgaaccgccccaaatcaccttcttgaggatcggcttaaatgtaaatggatataacataacgtgttttgtgtatagagttttactttttgaccttcactttccttaatacgacggcgctacgtgccgggatataaagtttcagccattctttcttttctttcttatataacggatcaaattgcgtgaaatgccttatggtatcatcagccaagccaaaccccccgaaacgggtagcgtcagtgttcaatacgacctcatattctcccttcggaaccaagaaaccgtaatccgtgaacgatttcgtcgggctaaagttgaacacaaaaaccaagtctttacgcatataagccaatatctgatcgccatcattatcccaaaccttctggataggggtatcttggaaattcttcacatccccgatcaattccaacatctcacggtcgaaatcgcccaagaaatggtacttcaaatccaagttgtccaccaaattccattggcggcgagcgtatttataagaccatccattgccctcccttgggaagtcgatccactccggatgcccaaactcatttcccatgaagttcagataaccgccattaatggtagaagccgtaaccaaacggatcatcttatgcaaggcgatacctctatctaccatgaaattatggtcatctttttgcatatgccaatacatatcggcgtcgatcaagcggaagatgatcgtcttatcacccaccaaggcttgatcgtggctctcggcataactgatcgtcttctcatcggcacgacggttcgtcgtctcccaccagatcgaagacggatgccaatcctcatccttcttttccttgatcgtcttgatccaataatccgggatgttcatggccatgcgataatcaaagccataaccaccatcttcgaccttggctgccaaacccggcatgccactcacctcctcggcgatcgttatagcgcccggattcacctcatggatcaatttattggccaaggttagataagcgatagcgtcgccatcttggtggccattaaaataatcgccgtaattacagaaagcctcgcccaagccatggctgtagtaaagcatggaggtcacgccgtcgaaacggaaaccatcgaacttatactcctccagccagaacttacaattcgacaataagaaatgaagcacctcgttctttccataattgaagcacagggaatcccatgccggatgctcacggcgttcgccactcaggaaatattggtcatacgaaccgtcaaagcggcctaatccctccacctcgttctttacggcgtggctatgtacgatgtccatgatcacggcgatacccatcccgtgcgcctcgtcgatcagttgtttcaactcgtccggcgtaccgaaacgggaagaggcagcgaagaagctacttacgtgatagccgaacgatccataataaggatgttcttgtatagccatgatctgaatggcgttataaccatccttcgctacacgaggcaatatattttgacggaattcattatacgtccccaccttctcctcgttagtgctcataccgatatggcactcgtagatcaaaaggggagacttcttaggtttgaatcgtttattcttgaatttataaggtttctccgggttccatacttgagcgctaaatatcttagattgctcatcttgcaccacccggcgagtccatgcgggaatacgttctccgctaccgccgtcccactcgaccagcaacttaaacaagtcctcatgacacatctgcgcatcggtcaaagcgatctcccatatgccattcgccttacgtttaagcttgtatttattatctttctgccatccgttgaatgttccgatcaaataaatagcggtagcattcggcgcccattcacggaacacccagcctttcgtggttttgtgtaacccaaaataaagatatccggaagccatctcggataaagttagtttaccattattcgtcaagctcttttctttatcaatcacgtattgataccggccttctatagccgcctcataaggggccagccacgggtcattttttatcagatttagagactccatgatttattataatttggttctcggcaaagataaaagaaaaaaacatacccattgataatattaggatatttcttatattcgcggtaaaccgtataaagatgagcaaaggaacaaaaagtatagccttttacctaatgatgatcctcattttcggttcgctgatgtactttatcgccaaagaaggggaaagtcagcaactggaaaattcgattgcgtccattcaaaacgcacctagtaatttagaagagggatttaccatatttactcaattattagtacataatatcgagtcttccataggaattctgcttttacaaatcatcacgatattgcttacgtgccgtttgttcggttggttattccagaagatcgggcaacccaccgtcatcggcgagatcgttgccggaatcgtgctagggccgtccgtattaggcaatttattcccggaggcttccgccttcctttttcctgtggaatcgttggtgaatataaatatgctgagtcaattcggacttatactctttatgttcgctatcgggatggaacttaatatctccgaggtaaggaaaaagctgaaagagacgatcttaatcagtcataccagtacgatcgtccccttctttttcggtatgctgaccgcctatttcgtgtacgacaaatatgcggataagagtacgcctttcctctctttcgccttgtttataggtatcgccatgagtattaccgcctttcccgtattggcacgtattatccaagagaaaggacttaccaagacacatttgggtaccatctcgttggcaagcgcggcgaatggggatatcaccgcatggtgcttgctagcggttgtcatagcgatcgcacaagcgggttcgatgctaagtgccgtttacaacatcttattctcagttctttacatagtgtttatgtttttggcggtgcggccattcctgcggatgatcggacatatctaccacaacaaggaggtaatcgacaaggggctggtcgctttcatcttcttgctattgatcacctcggcttatctgacagagatattgggattgcatgccttattcggcgcttttatcgcaggagtggtgatgccgggaaatgtcaaattccgcaagatcatgaccgagaaagtagaggatgtatcccttgcgctatttcttcccttattcttcgtatccaccggattacgtacggaaataggtcttctaaacaagcctgaattatggtggctatgccttatcttcatagtcgtggccatcgcaggaaagtttgggggagcgatgttctccgcccgattcgtgggtgagagctggaaggatagtctctatataggggctctcatgaacacccgtgggttgatggagctggtcgtattgacgatcgggtacgagatggggatattgacgccttccgtattcgtgatcttagtgctaatgacactggtcaccacctttatgacaaccccattggtctcattcatcaaattctgttaccgggcgcatgataagctgatggagcaaaaagaaagaatgccattggagggaatattcaaggtactgctatccttcggacgagccggaaacggacagatcatgctggacgtggcctaccagatgttcgcccaaggcaaaaacaaactggagctgacggcactgcatttgacggttggctcggatgtaaacccgctacacacggataatttcgaggaagtcagcttcggcccgatcctttacggggccaagaagctgggcattcagatacagactcgctacgaggtatcgaacaacgccggagtggatatttgtagcatcgtaaacaatgaggggtatgatttccttctggtcggttccgggatatcgatgagcaacacaccggacgatatagcggcaagccattaccgggcctcgttctacaaccgttatttcaaacgcttcaaggctccggaatcctggttttatccgggtgccttattgaaagacaagacgaagatgtttatcgagcaaagcaattgcccggtaggtgtattcgtgaaccggaatttcgtcaaggcatcgaacgtgatcgtggtcatcgactccgaggaggatttattcctgttgggatacgcccagaccttattgaagtctacacacggctcggccagcgtacttgataaatccagcagtacgaccccggggaacgaggtgatcaaggaaggaatcctgcgattcacggaagacgtgaagcagaccacgcttctacgagagaaagaccttacgccccagtctttcaacggcttcaacttcatgctgatcagttataagacatggaacgatgtctccgagcaccggaaagaagccttgcagaagatgccttctacgttgatattaagtaaataatccgttataaaccatataaacccgtctttatgagaatctgtcttttcttcttgatcaccgttttcctcatggcctgctcctctacggggaaccagcggcaggaaccggaaaaccagaccttggaaacgatactcaatcgcaaaagcgtacgtaagtataaggatcgcccggtagaaaaggaaaagatagacaaactgatacgagccggaatggccgccccttcctcccgtgacaggcgaccttgggaattcattatcgtaaccgaccggaaagccttggacacaatggccgaaggtctccccttcgcccggatgctgaaagagacaaggcaagcgatcgtcgtttgcggcgatacgatcaaatcctccaacgcttggtttctggattgttccgccgcctcgcaaaacctgctacttgccgccgaatccatgggattgggagccgtatggacggctgtttacccctatccggaccggattgagatcgtccggaaagagcttcggctaccggatcatatcatgccgttgaacgtcatacctgtgggataccccatgcagaaagagactcccaaaaacaaatacaacgtccaacagatccaccacaatggctggtaaagctatatgacttccagataactccgtccgtttcccgcccggttcacccggatctgcacgggaatacgttccgtcatttcctgtacgtgcgagataacgccgatcttgcgcccttgcgtacgcaggctctccaaggcatccatagcgacccgcaacgtctccgcatccaaagagccgaagccctcatcgataaacaagctctctaccttcatccggttcgaggagagagaggacaagcctagcgccaaggccagcgagaccaagaaagattcccctccggaaaggctatgcacggtacggatctcgtcgcacatatcttggtcgatcacctgcaaagccaaggtatccggcacacgctccaaccggtaacgccgggatagttgccgcaattgcacattcgcgtaattcaacaagacatccaaggtgtacccttgtgcgatcctacggaacttggcgccatccgcagagcctgccagctcattcagcttcgcccaacgctcgctcatcgccctccgctccgagagctcttgctggaagccggctatcttccgcttattctcctcgtgcgtacgcagacggaagctacattcagacttttgggccgtcatttccgacagggattcctccagcgtcttcccctcggagttctcttgataggcgaccatccagttatccagctcctgccggcgtgcggaaaggagaccggaagtctccgccagatccttcttgatctgttccgtaaccccccggtattgctccacctcgccggcgtgcctcgttgtactctcttgcagctgcttcaaatggctcttcaaggcttccacccgttcgtggaaggtacgttccacctggtcggctggctggcctcccagcaggagattccgctccgaacgcaagcgggtataggattgattcttctcgtcgtaggctttcgcggcgtcctcgtactgcttgcgcaagggagggaggaaagcctcgtacgactcccgttccgcttgatgggcgctccgctcccgttccagttcccgcaggcgttccccgttggcttgccactggcgggcgaaatccgtcaaggtctcccggaagctttccgggtccttgttccagcccgtctgccatgcgtcgttcccgaacagggcgttggccgctgatagggattgggacagcttctcctgctgttcccgcttatccagttcttcccggtcgatttgctcggacaaggattgtaactggttccttaattccgtccgtgcgttctcgtccgcggcgagttgtttatgcagctccaattctttctgttgcagggcggcgagttgtttcccgcaggcctcctgccgttctttccggtcgagaagccgcttgaggcgcagggtagcttccgagatgcgatccgccaaggccaacagacgctcatgcgcctcgtgagaggcgaaaggatgctcaaggcttccgcagaccgggcaaggcgttccggcggtcagcttgtcccgcaggcttttgatatcgccagtcgtcacgaactgggcttgctctagcaataaacgctcccgttccgtacggcaggtctcgatcgatcgatccaaagcctccggttccaattccttgagggcaagcgctacggacttccgctcttcctcgatctttacctgttccttggcgtgcgtctccgcttcccgccgcaaggattgcctccgaacctccaaccgctggattttctgtcggatggctagcaaggccttgtccgaccgctcgactgcccggcgagccgtaaggcaggtatccagatgaatcaacaaggccgacagttgctcggcgatcccctccttgctccggtaacgttcacgccacgacgtcagcttgtcccattcctccgaggctttcttctgccgctcttccaccttcctgagtttctcttccgcctcctgcttccgccgggagaagtctttcatccgttcatcagcctcggagcgggctttcaaggccgattccagttgcacgtccagtttccgggcctgttgcaattccagtcgcaagcccttagattcctcatccgtcctcgccaatcgcacctctccttgctcatactccttccttgaggtttccagcgatgccaacgcccgttccaagaaacgggcgttctcctcccgctgtttttccttcgaggcgatctggacctcggccgctttcacggcctcccgcaggctttgccgctcggccctcgccttctccagacgggccagctccacctccaaggccgaaaggcgggtttgggaggcttccacctcctcctccgacagaagctctatgtcttgtacgcgggcgtatagctgctcgtaggcctccttcgcctcggcgttcttggcgaagatccggcgggagatctccgagtattgctccgtaccggtcagtttctccagcaaggaggccttctcgccctgctccgctttcaggaaggtagagaaatcgttctgggccaagagcaccgagcgggtgaactgatcgaaagtcaggccgatcagctcgatgatacgggcttgcaggtccttgttggttcccggctcctctttcccggcatctatattatataatgtaaggcgggcggcctgcaaacgtccgctctccttctcccgggcccgggatacggaccagcgggcgcgataccgacacccgttcagcgccacgaaatccacctcggcatagcccgaggccgtcccgcggcgcaagaggaagcgggggtcgctttgcggcaacacatcctcttgcacgtccctcagccgcacgttattctccttcgccagctccgttcgcggcgtacgggagaagagggcgaggcacatggcatccagcaacgtggattttcccgcccccgtaggcccggatatagcgaaaatacccgccgaagccaaaggctcttccgtaaaatcaatggaaaactctccttccagcgacgccagattgcgtcctctgatcgccagcactctcataaagaaacctccctcatcacctcattaaacaatgtctctatctcctcgggcaactcgcctccgtatctcgcggcaaacgtatgcctcagcatatccaacggagctatcttttgcaaatcgttatacgacaaggcccgctcctctgcctccccttcccgccggggatacgaaggaacgatggaggtgaggcggaccgccttcccgaccaacgcctcctctacccgatgacggaacgtagggtccggctccgtcagcaggacccgtatctccacgtaaggccagcggctctcgtcctccctgccctcctccggctccggaagcccggcgaggcatcgcaagacctcctccggtggtaacgggctgtccggtatacgcatcaagtccgcgactctaggaatcccgatcgcctcgatctccgtgacactcccctcctcgatctctacagctatcacttgatgccggtaattcttctccgagaacgacatgggaagcgggcttccggcataacgtaccgcctcgcgcccgccgatccgttgcgccttatggatatgccccagcgccgtataagcgatcccggcgtcgaaggtatccgcggatacggactccagacctcccatgatcgcacgctcgctccggtcatcctccgatagttcggctccggtagcgtggaggtgtcccaaggctacgatcgcctcgccgggattcctccgggcatccgcataagcgtagagccgccggtacatccggccgatacccgccacatacgagtcgggctctccctcgggtaccgccgggtaatccccttggcggaggaaaggcaccgccaggcaaagcgcctcccgttctcccgcccggttcctcaaagggacgacgagcgaagcgaggtcgatctccccggaatccgtcctccccacgataccgacaatcgaggtattcaattcctccagcaagggattcggggcttccagacggatcgcggaatcgtggttgccggcgatgatcacgatctgcaagcccggattcaggcgattcgcctcccgcaggaaacgatagaaacggcgttgcgcccccgcggaagggttcgtcacgtcgaacacatcgccggcgatcaacaggacatccgtctgccgctccaccaatagatttgtcagaaaaccgaggaaagcctcgtgctccgcctcccggtcgtagccgaaaaaggtctggcccagatgccagtcggcggtatggataagtttcaatgccatatattgtcatatttataaaagcaaaggtacaatttttttctaggttctttcttttgccgtcaacatagccaaagagacatatccgcgtcaagggaataagttgtcgtttcttctttttcaggtctatttcagcaatatacatcataatatatgtattttagtcctaagtttataaattcttttgttacatttagagcgaagaatgatcatcaaccgtttttcccatagcaacggaatatcatagatttcctaaaggcaatgacatagtttacaataaaaaaactaaataaaaatcatgtaccatctgatactaaacgttctagttttctttctcccattgcttcacggggataaatcgaccgcatcaaatccggatatcaaggagggaaatgaggcttacacagtctcattctatccggaagggggccgattgatattaaataccgcctgcgtagtcgcattcaaggcagaaagcagagatggtagaacattagatatctcaggagagatcgtggatgacagaggtaatattgtacaaaacgtaaaatccttatataacggattaggatatttcaatatttacccagatgaaggaaggacctattatctgaactgtaaaagcacagaaggtatagaaaaaagctttatattacctgccgcaaccctgtcaatagggataaaagtacatttcaaggaagaccaaatattagtctccgccttaaaaccagagcatttgcaatttaaagacactttatatatactgttacaatccgaagactccatcgtttataaagacatttgggatttctcaaggagatggatcgtattcgagaaaaaaaacatcaagaccggcctgtctagttttcttttagtcgatagtaatggcgatctactttccgggcgaccgtttttcaagctagaaaatatctcatcactccaatctttgcctccggacttcaagataaggctacttcctatcatgaacgatccgggaactgactccatacggaagaatctcgtattggatactttggccaagactttaacaatcgaccaggaacaatcggaacctgataaaaggccagatgatgatatatggaagaccatcgagttggagaatgtagaaatcaaggcattcaagaaagacaaacagaatcaaggactctattcgcccgtccaagcttccagccgtatttatagctcccaagatatagaacggtggcatataaatgagatgaaatcgttattatctcgctttagcggggttaaatttatcttcgatgacgttaagcaaaaatattatccggtactccgtgacgcgataacttcctttagatcaaaaaatgaagggaaacccctagtcgtgatcgatgacacgccttttatcgatttcgacatcctagattaccccgtcaacgacatagaagagatatttttactaaaaggatcagacgctgccatatggggacctaaagctagcaatggaatcatcgtcattataacccaaaggggtaaatccacaaaaaccgagcaaaaagaggagtaaaatgagaatcccgtccgggggcggcaagacatccgtttcccgctccactatccccccttatataccggcagcacgaccgagaagcggcttccttctccctgcttagaactcagcgctatccgtccccccaagttttgtacgattccttggcagatagacaaccctagaccggccccttggctgaattcatcttgcttgaaaaaacggctgaacaccttctcttgttcctcctccgatagaccgatcccggagtcctcgacaaatatcgccgcctcatccgtgcccctcagatgcttaaatcccaactttatatatccgctattcgtgaatttacaagcgtttgtcaagaaattggttataacttgagaaagtctctttttatccgtatagataaacaaatccccctccgcctctttcgagaatcgtaggtgggcggggaccaataactgatgggcgaggtaaagatcgtctaccaactccttgacggagcagctctctttctcgaatttcatttgtcccgattgaagtctcgaaacctccagaatatcattgatgagcaccaacagcagatcgcagctctgattgatcgtcttggcaaacagctgcttgtcggcctcgtctaagtccttctccgaggccagcaggttcgagaagcctacgatagagttcagcggcgtacgtatctcatggctcatgttcgccaagaacttttgctcatatcccctcatgaggataagctctttttcccgtttcttcatgtcattgatattgataagtataccactcacgtctttgcctccctccgcattatctaccgcaggcatggcgctaaagcggaattcccaccattcataatcagatccggtaaagcgggcacggcattggaatacctccttgtccgctttccataaagattgtctcagtaacttgaaagaagtgaggtcatcgggatgtatatgcctccacactgtatggccaaatccaagaagaaatacttttgagacagacgggaaaacatcactcctgtttgcttcttctcccgcctatacaaatataagacaccgattaatagggtgatagaagctgtctcaaaaacaggtcttagcctataatactcaaataagggcgtatgcttaggtaacaaatatatccccgtaaacaaggttgctaaaactaaaaatatataaagtagatatttcatgattccatggtttaaaaaagtatttcaccctatgctctaccccaagttcccattgtaaggagatctaaacgagcgtttagggacatcctaaatgagcgtttagggacatcctaaatgagcgtttagggatgccctaaatgggcgtttaggatatccctaagtccaaggtcaaatctcatcgggactttcgctatccggatttccagttcctactgagagaggataaggaaaacgattcctgcggatttccttcaagaaaaacttgttatttcccccatactgcgtggccacttccaaataataagatccatcagctaaggcagggataatcaacgaaaaagcggaaggatcgtttcttatcagggaagtcatcggtacggctgtctccgtctcgtcttttgcgttgacgaagaagaaaccaaccgccttaccttcttctccagctatttttatacggttacccgtaccgaccaaaccaccaccggggggcaatttgccgttttgagtcccagtagagacatccgtcactaatgatcgtagggagtccttcctctaccgcacttacgatcacgctaatgcccttcatatcctccttaatctcggcacggggggaactccatagaacaacgctgttacgtgacgggtcaaactgggccttaggtccgatgaaagagccatccacgcctaatgagttattcgtaaatccaaattccacggtagaagctgagtaaacttcttgtttagcgacagcaaacaaatcgttataggcactttctaattcagaggcggaaaacttgctaccattttgagcagccagtttacaaaggtctttgatcgtacggttcgccacataagttaccttgtaagtaaaatcgtcttctcgctctgttaacatatttgtgactagtttaccggttatactacgcattttggggtctgttgaagtcataataatcttgaattatgagtcctcatggaacgatgtcgaagcactatctttggtttttctttttaactttctgattaacaatagtttgaattatattggagagttcgtgattgtagtacttgaatactgtaattgtcgaaatcttcggtttattgacgacaaataacagaatagagctgtatcttaagaattgtagtaacatcgcgatctcggattttaagtattattatgatggatttcccgcgatatgttttatccagtcccgatatcaacgagaagactttgtgaattttatcgaaagagaaagatgggatggtgattcttgaagcaccggaatggagtccgatccgacaggtcaacttcgtagcttcactggataagatggctgctgaccagacgaagaaacgctatccggaaatagaagtcccgaatgaacgaccatttaaatgtctttcttttgcccgtaagtcttttgtctatttcctggatctggatagagtcttgtacttacatgccgatcgttcacggtcatatctgtttatactctcaaaggccagtttatccatgaattctccactaaggggggagattcagccattccgttacctcgaggagtctatatcctgcgtatggatggtgaaacttataaaattcgtctttaaatgaacgtaacagagatcgtgaaaagtgtgatttaatgatcgattgaggaaggcatccttacggatgccttcttttatgttgcatacgtgcgtttgatcattaatggataaataatcctttttttgttgtctaatttcttgattattagcggcatttgttgtaaaatggatgaagttatagcgttactgaaggaacatttgtcgaaatctaaagtaaaggaaaaagaacttgctttccgcattgaccgtctgctagaagaaattacttccctgaaagatgatctccttcaggaaggcaagtgttcttacattcttgtccccatagctaaagattttaattcataatgttttttgtagtttcatgaaaaatgcttttttcgagaacaagtacctgtttcgatagagaatagtaagataatcacaccaaaatacagtgtacattattctatgtaactaaacaggctaatcgaatatacaaagaggggataagatgatgctcattcttatcccctcatgccatcagttattcaaaaatagtaccttatactactaccatccgcacaattaatgcgtcaagcaataatatggctctttcttggctttataataataatttgtaactacttagagtagtcattttctttctttttatctactctgatcaatagagtggtttatttcgccacgtcccaccatatgcgagaactgaagtgatcgccaccggacagacggctaacagctgtctcgtaattagccgcattgtcttgcgactctttcgatgggtagcggaaacgacgggggatctctccattcgtatctgcgttaggatacggattggccgggtcataggtcgatttcaattccggatagccggaacgacgccagttagcaaaggtctcgtattcatcgcagaaacagttgatccaatattgtgtgttgatctgttccaacgctttcgatgcattgaacggattctccgtcaaatagcggtcgatcgcggcctgcgtcagatactgattgtacagcgccgtgccgttggggaactgtgcgaactgccgcatggcagcgcgtacgccattctcgtagtaggtctgcgcgctcccgtctacccagccgcgtacggcggcctcagccagcaacaattgcgtctgggcataggtgcagacgaacgtcgggcccgtcgggtcggaataggtataacggtttatcgtggaataacggctcctatacgtgctgcggtaatcctcgtccttgaactcgggatatttgtttcctacgaaccacgggctatcggggctgtcggagaagccgctaggcaatcctttctggacggccggggcggaatcgccatattggaagtcgctacccgcctgcaccgagatggtcgggtcctcgcacaccgtaccgatcaacgacaggcgcggatcgttagtacttttcagcagatccacgaaatactcggtcaggaagaagttgccgcgatcctcgtgcgagtagatcttggcgtatggctcggaggagtcgttcgttgtcaagccacccgcatgcatcagcatgcagttgtccgcgtccgactcaaacaccccgttggctaccgcggtcttcacccattgctccgccgcggccgggtctaccttcgacatacgcatcgccacgcgcagcatcagtgagttggcaaacttcctccacttcgaggcatcgccttgatagaagttgtccgccgatttcatcgccgccgccgatgcgccgttcaaggcggcctgtgcctcgttcaattccttcagcaaatccatatagatagattgttgcgtgtcatactccggaaaggaatacaactccggctgtaccgcctgcgagtaggggatatccccgtaaaggtcggtcatgcggtgcatgccgtaggcgagcatgatacgggcgatttggtaatcggtctgccgtgacggatcctctttccaagcctccaccgcatctttcatgtcgcggagcgccccgcgcgtgtcaccgttgtagatttcccaatacgcacctgagtagccgtcgttccaagtgtaattcgcattacccgaccaattgaacgatgcggtatggctcatccattgagccgcatagatacaaccgtttcgccatacgtcccaatcagatcccaacatctgatgctgaccgttggtgaacaataactcggtcgggatattctccgaattcaggtgctccgggtccatattcacatccccgaaatcgctgcaacccgttcccccgatcatggccgcggcggcgcacgtcatatatactaaatactttttcatactattatacttcttcaaacgtgattagaatttgacattgacattgaaaccgacatttctcgtggccggataaccgttcaactccaagccctgtccgttcgtgttgttgtaagctgactcgggatcgatgttatcggtatgcttcaagatagtccataggttacgtcccaccaacgagacgctcaagcccttcaccaccttcatcttgttcaagacagactgcgggaaggtatagccgagcgacaactcacgcaacttgatgaagctggcattgtagacgaactcctcggcgatattattgttgacgatccccttgtgataatcctgcgcgtttaccgccacgttgttctctccaaggatctttccattgtcatctatcatgacaccggcaccgataaagccactgcctcccgggttatcgaccgtacggccaagcaacgtacccttgtgcagaccctcgctgtagagcgagtagttcgtgccggagaagaggcttgcgcctgccttgtagtcaatcaagaacgacaaggagaaatcgcggaatctcaacgtgttgctccatcctccggtatatttgtagacaccgttgcctaggttctgcaactcgtcggtcgcttgcgggataccgttcttatggatgatccggccttgctcgtcacgggcgtatttgtagcccaccaacataccgtaaggctggcctacgatgttgcggacggtcacgttgcccgagcgtgcggaggctccgtcgatagacagggactctacgcctcccaggtatttcacctcactatcgttgtatgcgaagttgaaggtcgtctcccatgagaagttcttcgtatgcaccggtgtcgcattcaccatgaactcgaaaccttggttccggatctcgcccacgttcatgtatttcgatccgaacccggacgcgctggacgtggtgacaacagcgatatcgtctgtcgtgttcttgttgtagtacgccatatcgaacgataggcggttgctcataaacgctaggttcaagcccacctcgtactccttgatgctgaccggtttcaagtctggattcgcaaattggttactgtttgccgtacctccggtctgtccgttgatctggaaattctgaaccttatacaccatcaaggtcttgtatggatctgtaccattggaggagcttgcccacgagccgcggatcttaccgaaatcgaaccaatccggcatattgtcacggaaggtatcggagaatacccacgagagcgtcacggacggatagaaatagctgttgctatccgggttcaaggtggagaaccagtcgttacgtcccgtcagattcaagaacacttggttcttccatccgaagtccgctgtagcgtatatggagttcacccggtattccgaatagtccttcttcgatcgtttatcgctgagattatttacagaccacagtccatcgacgataaacggacggcctccatccgtcgtatagaacatcttgttgatcgtacgctgacggttaccgcccaacgtggcgccaaccgaccagtcgccccactccttattgaacccgatcaagtagttcaagttcatctcggagaagctacgggagtattccgtcatccagccttgtggatccgcagcagctccagtcggctgtatctgtttgaactccaaattgtaaccatcgcgttgaacggcaccttgcacatacaaccaatccgtgatgtcgtatttcaaggtcattgatcccgtcaagcggttcttctgcatatcgttggttttccgatactgcaaccagtaggggttgttgaaatatacattgcggttaccattaccgttcatttccgagccgtcctcaaaggaaccccaaggagcgttcgccgagcctctttccaaccaacgtacatcgaacgagttcgccaagtgcagcaaggtagcgttggtattaccgttgccatcggacaggttcgaacggcctttcgacttctcgaacacatagttggcgttcacgatcaagtgcaggttcttcaagatatcatacgtcgtattcatattgataccttgctggctgttactagagttcggtaactgtcccttctctgctacgttggatacgccgaagcggtaggtgatcttgtctcccgcgccgctgagcgaggcggaagttgagttgttgatacccgtgcggtagaaattcggccaattgtcgatatactcgtaaggcacctcatttcccaggaagttggtcgccgtaccacctaaaacgtctccccagctactagtctgcgtggtctcagctcccgctacggaggtaggacgtacgccataatcaccctgcccgaatacattttgaaagtctcggtagtcgtagatcatgttaaaagtcaagttgttgttgaactcgatgttcacaggcttacctttctttccggacttggtcgtgatcaagatcgcaccgttaccaccgcgatatccgtacaatgcggatgcggcggcaccttttaacacctgtatgctctcgatatcgtccgggttgatgttactcaatccatcacccatatctataccgccccatgtgccggccgatcctaagttctggttactgaagggcacgccatccaccacgtatagcggcatattattacctgtcagggaggcgtttccgcggatgatcacacgggaggaaccacccgtaccggtcgagttaccgcctacgctaacaccggccaccttaccggaaagggcgttacctaggttcgggtcacgggccatcgtaaagtcctcgccacccacttgcgtcgtggagtaacccaacgagcggctttggcgttttatacccaatgcggtgactaccacctcatcgatcttctgcgtgtcctccgtcagtttcacttgcaagcccgtctgcccgctcgccgtgatctcctgtgtcgcataaccgatataactgatctcgattaccgccccattgggaatctccaaagaaaagtttccgtctagatccgtaatcacgccgtttgtcgtacctttttggatcacgttcgcaccgattacgggaatacccgcttcgtctacgaccgtacctgtcaccttcttgtcctgctgtacgcccatcacctcatcaaccgtgcctacggaagcaggaacggccatcgccgcgtttacagaaaaagcggaaagcaacaaacagaacgccgaggttttagctatccattgaagggataatagcttagattcattctttgtcatcttgcttttgttttaaaattaagtttaagtttagattgattacatttattcctgtaatgttatatcacaatatgaacatggttccagcggaactaacgtgttttagatacgtttaagatttgattttcttggtttcaaaaggtaatttgtgacaaatgtgttgtttttttctaaaaagcaccataaatttaagtatagtttacgaaaaaaatgtatctttacatcgcatttatgcaatagaccatgaatggtacattagttccgctgggacaagtttcatccagagaccaaaacaacctcaagtatgcatggtcccgctctaaacgaaaggcaatctctctaccaaaaataaggccgatttatttggcacagatcgctatttaccatactcttgtgtctgatttaagattgaaatccttagaaatatttttaagcataatctgtatgaaagctagttgatacataacttcagccatctcacacagatatttataatcaataattaatcttctggagttcctcaacaagagagcgatctttcaacaatccatctcttaggtaagacaaggaattcgtttgggcgctcatttagccagagtacggcttcaacaacccaaccgaatttgtccgcaacccaatcccaagcgctccttggcactctctgtctgtaaggatcttaacgaggcgcaggaacttatattcaagttattcaataaccattggtgctattctccattggtaacttgattgatactgtaaactctaaccatcatattttttagtttgctgatacttattatttttatattgaaatataaggttattttattcatttcaaaatgacttctaattatttaacaaactattatgattcatttgttaaaagtgcttgtcaaaaagatagcgaaacaatcgaacataacagtcataccctgtttattaatatatttctctcttgatcgtttgcttttatacctgatttttttgaattttgcatgcgataaacaatatgtactcggtacaataagtataattaatgtcatgaaacctactaatttactattatttccaattattatcctttgttctttcacttcggtcaaggaaatacctccttacaagaatccggcacttccggttgacgaacgagtgaaggatttattagggagaatgacgatcgaagagaagttctggcaaacatatatgatgcctggtgatctggataaagggaaagaccgcttttcccacggtatcttcggattccaggtttcaaccataggaaccagtaatccggaactcaaacaattgctgcaatacaacccgaaattaacagcaaaagagatggctaaaaaaatcaatgagatccaacgttacttcgtagaagaaacccgactgggcataccgattattgcattcgacgaggctttacacggattgattcgtggtggtgccacggcgttcccccaatccatcgcattggccgccacattcgatacggccttagtacgccaagtctcccatgctatcgccatggaaacgaaaacacgtggtatccgacaaatactatcgcccgtggttaatctcgcaacagatgtgcgttggggacgtacggaagagacctatggagaagatccatatctttcggcatgcatgggtgtcaactttgtaagaagttttgaagaaatgggagtgataaccacccctaaacactttgccgccaattccggagatggagggcgagacagtaatccgatccatttcacggaacgatttttggaagagacgcatctggttcctttcaaggcttgcttccaaaaaggacagtcgcagtctgtaatgactgcatataatatgttagacggaactccttgtacagccaatccctggttattgatcgacaaactccggaacgaatggggattcgacggatttacgattgcggatgcagatgctgtcggtatcatccacaagttgcatcacaccgtcaataacttctcggaagcaggagctgatgcaatcaatggaggtctggatgtcatcttccagacaacatacgatgaacaccgaccattcttacaggcttgcctagatggtttagttaaggaagaagcgctggacagggctgtaggacaagtattaaaagcgaaattccgcctaggtctgttcgagcatccctacattgacgaaaatgaggcggagaagtggaatgcctgctccgcacaccggaaactggctctcgaagcagctcgcagatcaatcgtgttattgaaaaatgaaaatcgggttttgccgttatccaaacaagtaaaacgtatcgcccttatcggacaagatgccgctcaagcccgtttaggagggtacagcggaccgggcgttgacaaagtcagcattcttgatggattgaaaaataaactgggcgatcgagctatcatccgttacgaagagggatgtaaacgaatcaatccggaatatctgaccgtcccaaccgattatttatccacatcagacggactgtcgggactggaagggcgctatttcaataatatctcctatgaaggagtccccgatttgaaacggattgacaaacgcatacaattctcatggacattgtttgccccggattcttgcctggctgtcgattggttttctgtcgaatggaacgggaaattaaaatctcctgtctccagaacatatcggctcgggctggagggaaatgacggttaccagctgaccgttgatggaaaagtgctagtagacaaaccatataaaacctctttcggtcacacattagttccttttacctttgaaaaaggaaaagaatatgacattcgtatcaggttttatgagaatacaaaaaacgcacgtatccggtttgtttgggacgtggatacaaaaaatgaagaccagtccatcgaacaagccgtacaagctgcccgtgaatccgagatcaccatcgttgtcgtgggtattgaagagggagaattccgtgacagaggctatctggcattgcctggccgacaggaagagttaatccgtagagtcgcagcaacaggaaaaaccactgttgttgttttgatcggtggaagtgccgtggtcatgtctgaatggcaggatcaagttccggccgtactgaatgtctggtatccgggagtggaagggggcaatgcggttgccgatgttttattcggcgattataacccctcaggcaaactgccgatcacttacccgatccacgaagcccagctaccactcaattacagtcataaaccgaccgggcggagcgacgattacctcaacctgaccggtgaaccgctttttcctttcggtcacggattgagctattccgaatttgattattctggactaaaagtgacgaaagcagtacatggcacagctttccatgttactttttcggtgaaaaatacggggaaaatacgcagccaatgaagtcgtacaactctatttgtgcgaccaggtcgcttccgtaacccaaccaattatgcggctgatccatttccagcctgtatcattggcaccgagagaaacaaaagagttgcacttcactgtaaacgagaaagacctgtccatgctggataaagagttgaactgcgtgatcgaaccgggtgaattccgtctgatgatcgggcgctcttgtaaagatatccggttaaagacaacactgacaataaatcatccaatgactttagaaacaaaccattaaataaaaacaattaccatgaaacaattgattcaatgcatgggtatgctgatgttactgtttgggctttcctccagggtatcagcacagataacccttgtgaaagatggtaaagccacttcacgaatcgtattagttgagaagaatgaagtaaacgagcaagcagccaccttgctgcaagactttgtcaaacggatcagccaggctacgcttccgatcgttgccgatacaaaggctagaagcggggacattctgattggaggaaaacaagcctcagccggagaagacggttttttgctgaaaacgacagcaaacgaacaactacaaatatccagcggaggcgataaaggcgccatctatggtgtagtttccttattggaacaatacatgggcgtgtcctattttgcaaaagaggcctatacgttgactccgatgcagacaatcacacttcccgctatccacagggaagaaacaccggcattccgttatcgccaaacttacagctataacaacgacgacccggtctataagctatggttccgcttggaagaaccaaaagacatgtttatcgaaaacatgtgggtacacacgttcaaccgtattctgccgtccgaccggtttggcaaggaacatcccgaatattactcattcatcaacggtgagcatcgtccgggacacaacagccagtggtgtctgaccaaccctaaagtattcgacgcagccgtacgccagctagattcgatctttaaggctcacccggacatgaaaatgatttcggtcagtcagaacgacggtaacaatacgaattgttcctgtccggcttgtaaagaagtagacgagtacgaaggttcaccttccggcaacctgatccggttcctgaataaactggccgaacgtttccctgataaagaattttccacattggcttatctgtattccatgcagccgcccaagcatgtgaaaccgttatccaacgtcaacatcatgttgtgtgacatagattgtaaacgtgaggttccgttaaccgataatgcctccggccgtgatttcgtaaaagcgctggaaggatggtcgaagatatccgacaatatatttgtatgggattatgggatcaatttcgataatatcgtctcaccattccccaacttccatatcctgcaaaagaatatccaactattcaagaaaaatcatgtgacaatgcacttttcgcaggtaaatggtatccggggcggggatttctctgagatgcgggcttacatgatcggaaaattaatgtgggacccataccagaacgccgactccctgatgcgtaccttcatgaatggttattacggagcggccgccccttacctgtatcaataccagaagatcatgcaaggcgcgctgctggccagcggacaaccgttatggatatacgattctccgatatcccataaaaatggcatgttgaaccccgttttgctgaaaacatacaacgaactgttcgaccaggcagaggaagccgtcgctggagataccgtactgttgcgccgcatacaattatcccgcctcccgctgcaatattcggaactcgagatcgcccgtacacaggtcggtacagataaaacgaagatcagggaattactcgggctattcgaccggcgtacccgtcagttcggcgtcacgtcattgaatgaacgtaaaaacgcacccggcgaatattgtgaattgtacaagaaacgattcttgccgcaaaacgagcaaagcaaggcctccggcgcctccctcacctggatcatcccgcctcaggaacgttataaaacattgggcgaaacagccctgaccgacgaactgttcggaggaacaacatatgtagaaagctgggtaggatggaacgggacggacggtgctttcattctagacctgggcgaagagaaaagtttcacccggatagaagcggatttcctccaccaactaggtggctgggttttattgcctcatagtgtcagctattctatatcctcggacaatacgacatacaaacctttcggctcgtttacatttgctgaagaccgggacctgcaggttaaatttgtcgaaggaaaagcggagtcggatagccctgtcaaggccagatacatcaaagttgaggtcaaagggatcggattatgcccagactggcattatggcgtaggttatcctgcctggttttttatggatgaagtaagtgtatattaaaaaatccgtgatccaattatgaacagagaactattattctatataacagcaatactgctttgcgccgggatactttcctgcaataaaaaagaagccaccgcgacatgcaactatgaggtagtacctctgccgaagtcgatcactccagctaaagaggccccttttatattgagcacatccacccatatcggatatccggaagaaaacaagaagctgagacaaacggcggtttttctttccggatatatccgcaaaatgacaggcatcgaaacagaagtaacagcagatacgggttcttccaatagcattcgcctcgtattagatcgtactgccgcatcttcaccggaaggctaccggctaaaagtcggcaagagagacattaccatcacggggagttcggaagccggtatattttatggtatacagacacttcgaaaatcactccccgtgacgggacaaaaggagataagttttccggccgtacagattttagacgagccggaataccgctaccggggaatgcatctcgacgtaggccgtcatttcttctcgactgatttcatcaagaaatacattgatattattgctctccataacctgaataccttccattggcacctgactgatgaccagggatggcgtatcgaaattaaaaaatacccgaagttgaccgaaattggctccaaacggaaagagtcgttactgaatgacggtcccgggaaattcgacggaaaaccatacggtggtttttatacgcaggaggaagtaaaggacatcatcgaatatgcggcagaacgttatatcaccgttattccggagattgatctgccgggacacatcacctccgcgcttgctgcctatccggatctaggatgcacaggaggcccctacgaagtggctactacgtatggtgtccataaggaggtattatgtgtcggcaatgagcaatcgcttcgttttgcgaaagatgtgttatcggaaattattgagcttttcccttcccattacattcatgtaggaggcgacgaatgtccacgtgaccgctggcaacaatgcccgaaatgccaggcattgatccacaataacggatggaaagatacgaaagaacataaagcggaagacaaactccagagttattttatgacagaagtggagaggttcgtcaacagcaaaggacgtcagattatcggctgggatgaaatattggaaggagggttggctcccaatgcgaccgtcatgtcatggagaggtacggaaaatggtatcaaagcggctgaaatgcaacatgatgtcattatgactccagcgggtatcacttatttcagtggccgccagttattggaactgggtggtaaccggggggttcgccgtgtctatgatttcaaaatctgtccggatacattatcggaagctgccgccaagcatatcatcggtgtacaggcctgtctatggtcggagcgaattgataccccggaacgggctgagtacctaatccttccacgtctggccgcgttaagcgaattaggctgggctgatcctgaacaacacgatttcgacgcttttatggatcgtttgtatcgtttgataactgtatatgacaaatctcattatacttattcggaacatgtttttcaaataaccgagaacttccggacagacacgttgcaagatgcgcttgagatttccctttccactatcggtaaccgcccgatctactatacgacagacggaagtcaaccggatacagcttccctgatctatacggaaccattgataatacgggaagacaccaaactgaaagccgttattgttacgactgaggataccagtagtgtatttgaggaacatatccatgtaaacaaagcaactttcaaaccttcctggctggccaatgcaccacatgagaactatactttcaacggggtaagcacgctgactgacggattacagggtaatcagaactataacaccggccgctggctcggcttcctgaaagatatggatctgaccatcgacctacaaaagtcgacacctgtctcttcggtatcgctgactgtcaacgtctcaaaaggagcagccgtaatggatgccaccgggctggaagtatggtgttctgaagatggaaaagagtaccgaaaacttgcttcagcctcttatccggttttagacaaggaagataaagacggtatttacccgcatacgctttctttctctgtggtggaaacccgttatgtacggatcattgctagagttacaccgaaattgccagcctggcatatgtggcccggcaatcccgcatttttatttgtggatgaagtttgtgtaaaatagaatagaacggttatgaaggatagaaacaaacgccctctcttccaatatctggaaggattcgggggtgtggagcttatacaaacaaaaaatgaggaaggtaccgaatatgcggcgtgggtacgaaaccgagggaatataggaggtaccgtatggctggggttcgtccatccggaaaattggaaggagtttgaggatgctttcgacaaaatgatggataaatatattgtcaaacgacagtaagttttgatttgtattccgatccctcatgttcctacgctggatagcccagctaccgactaaaaaaagcgaccctaccctcacgggaaaagtcgctttatctaactaaagtcttaatctaaaaaaatcatattacaaaggtagatatatttctaggggctatcccaactttgtaggacagccccgcttaaagaaagtatatcccgtattacaatcttgcatatgtcatctcgctcttgaggtggatcatgtctcccatatcctcaaattcctcctcgtaatatatgacaagtttggaagagcttaattccttgacagtgatactcatgggagtctcgctatctatcgtgaccgtaagtccttttccgtcatcgctcagtacccatttgccattgtctgtctggttttctgacggccactggcaggaacagctgccatccgccttgaacgtgagaatctcctcacgagcctccgccggatattcttccgtatcggtttccccgtttatgtccgtcatgtctttaatcaggacccattggccgaccaacatttccttggcggtctggcctccgtttttttcatcgtcatcatcacaggatatcatggaaacagacataaaaaacgttaccataagcaacgtcatcaaggacagtacactttttttcatcttttaaccgtaaacttttgttatattcttattcgtatcattcttaaaaccggtacatggcacttgccatcggtacaaattgccctccgtcaacgatctggtatttggcttccacaccgacagcccaattgctgcccaggttcagttggccgccaatacccaagttggcaccaaatttcccatcggaattgctgatggacgccccggcaacgtccgtggaccccttcagatgcaaataagtgagaccgaccaggggataaaatttaaaaatctcgttacggaagacgttccaatgaaaatccgcgttgatatcccaacattttaacttcccttccacgccgatcgctccaaattccccaaggtcgacagtctccttgaaatagtggttgaagctggcggcgactgtgaaagcgtccgtaatgtcgtagtgcgcttttgcaccgaggaacggcttggacatgtcagtgccgtaaccgatgttgataccgccccccatttcgtctcctaggcggatcctgagatcaatgccatgcagaacatggcggccattaaaaattttttcatcatgtgtttatgttttttaaattttcacacggcaaaattatttccaatgactgatttttcaaacacgggtcttgcctgcctaggcaaatgggacgcttcttttgggaaatgagacattttcaggtggaaatgggacattttccaagtcctatgacacacgggagacgccttatttctccatgtatcttgacggggactcgccgaaacgtttggtgaaattgcgatagaaggtagaacgtgaggtgaaaccacattcgaatatcagttccttcacatacttgccgggacggttctcggcctgccgtttgaaatattccagacggaggtcacagagattcgtgaaaccggcgacctttatcgtttccgagagaatggcttccctctcgtccatatcccttgccagatccttcaggctgtagtccttgtcggtaaaaagattatcccttttcaacgttttctctatccggttaaaaaggtaatggaggcgcgtccccgcattttcagtcggcagcggtccattggcggcctcttcccgggcacggtacttcccgccatgggacgagaaaggattctcatcgagcaggtattcaacggagaacaccagggagaagacgacggccgttataccgaacaagttaaatatgaattcattgacgctcaatgagaaaaggatgtaaatgataagaaaaagaaacatgaaccccaaaaacaggtacatcctccggtttatcttgcggccggttttagggctgattaccggatatacggccggaaaaagcggtgtcacgaccgtcatgaagaaaataccgcaacgcagccggatatcggtattcccaaaattggagaggatctgggacaatgaggttacaggcgtgaaatgcccgttgaacccactgtaacagattcctaccgtagtgactacaataggaagcagcataaaggacaggaccttgaatgcggacagataccccggcctgagggaagcgacgggaaacaggcatactatacttgccgggatgtatcattttagcattttctccatattcagaaggtcggagaaacggtatgccggagtttccgatacgattgtcagccaaccagcgttctcccaaagaaaaaccagaccgatacagaatgatatggcaccccagtaccgcttttgaaaattgtcctttgcccggagagagataatgcctcctatgacaaggaccagcacgtcaaacacaatctcaatcggaaaatgatatagcgcaattaactgcaacgaattagaactaactacaatgaagccgctgatttccagcggcttttttgttttccaaaaatccaactataaacagtcagatatagttgtccaccatatttttctaccgtatttctaccgcgaaacattttcaggatttgccccgatgtcacgatgacgcagtagtttacgtgtgttgacaatggtttacgtgagtagacaaaaagggaaataaaaacgcagcctttattattggtcgcaaaggctgaaattacccgaacaacgaaagttcatgtttaacgaaaatatggaggacaaacaaaatggaagtaaaaagaatctgccagtggtgcggcaagcctttcatggcaaaaaagactaccacaaattattgcagcccgcaatgctccaaaagaggctataaacaccggatgaaggagcgcagaatggaacttagggaaatccaggaaatgcttgagttaaagagaaagctggaaagccaggaatacttcactttttctcaagccgccaaactgatgggggtttctcgccagtatgtatataagctggtaaaggaagacaaacttcgtgcatcccggctaagttcgagaatgtcactcatccgcagaggcgacattgaactgatgctgaaaaccaaaccttacgaaagcatcaagccaaaggatgatgtcgatataaccgaatattatacagccgaacaaattgcggagaagtacaaggtaaataccaaatgggtatggacatataccagagaacatgatgttcctaaagtcagagtccgccaattcaactactacagcaagaagcatatcgatgcggcatttgccaagtacaggacggatgatgccctgaccgaatggtacactcccgaagaaatcgagaagaagtacggaatgacacgtgttgccatccgctcgcatgtctatcgcagcaacatcccctcgaagaaagagcacggccagatattctactccaaacttcacttcgacctgtcaaaacagactgctgaagatgactcgtctgaatactacacagtacagaaagccatgaagaaatacaatctcacccgggattctgtttacggcatcctgcaattccacgaaatcaaacgggaaaagaaaggcaggttcgtgcgctttctgaaggtggaattcgaccacatcatgggtgctaggtaacgcatctgtgcgcacagatatacagaccggaaaatgattttatgctgaatgcggtctgcataaagccattgtgcaacttagccgcaaaatttaatgtcaactaaaaatattcgaaactatgtcagaatgcaaaacagttacattgaggacgcgccctttgaagaaaggtatgctgtcgttctatcttgattattatccgggctaccgggatcaggaaacaatgaagaccatccgccatgaaggattgaacatttacatctatgccaaccccaagaatcagcgtgaatgcgacttcaacgctgctatgtctgaaaaggccgaagcaatccggtgccggaggtttgaagccatcgtaaatgagcggtatgatttcttcgacaagcgcaagtacaaagcggactttctagagtatcaccggaagcagctccgtaagcatgaccagaaatggggatttgtctatcagcacttctacaacttcgttcacggcaaatgtactttcgaagaaatagatgtggaccagtgcaacaagttccgggaatacctgcttagtgccaagcaactccggcgtgacggacagatatcaaaaaactccgcttccggctactggtccactttccggggattcctgaagattctgtatcgcaacaggatgataaagactaatgtcaatgactttctggaaaaaatcgaaccggaagatgttgccaaggaatacctgagtgtggaagaactgtattgtctggctgaaactccgtgcaagatacctgttctaaagactgcctccctcttttcgtgcctgaccagtttgcggctcagcgatatactttccctttgctgggaggaaatcgttgactttgcagctggaggaaaatgcgtccataccatcacccagaagaccaagaccgaggacatcatcccgataagcgatgaagccttggaactgatcgggtactgtcccgagaaaaaaggtcttgtgttcaaaggcctgaagcggagctggacgcagcagcctatgaaggaatggatccgttccgcaggaattaccaaaaacataactttccactcataccgcaggacatatgcgacccttcaggctgcagcgggtactgatatccgtactatccaaagcaacatggcgcacaagagcatcactaccacccaacgctatatgaaagtagtcgacagcaacaagcgtgaggcgaccaccaaaatcacattgacaagaaagggctgacctgattgattcatgcctgttttatcggttagagtatgatttttcgctgaaaatcatactctaaccatattttttcttaattcccgactgattttccgtcattatttacaactgtctgaaaccggacatctatttttgtcctatcataattccaaacaataacagtttatggcagataacaaccgaatatccatcaaaaagacaagccaggttcttgcgattacgtgtgtcgcctatacgacagtggcaacaatattgtacaacaattatcagattgacctgatcgactattccactccggtcatattaggaaccgtagcaaccatcatgtcatgcgctgcactgcaacgcctgttctgttctctactctccaaaagctatctttcttttggctgcaaggagttatcctcaagaggaactgtcccttccgaagcaaatcctgataccaaggaagaattgcctccaactgataatgcaaccagtgaaaaacacatcgagagtccatatcttaaggaatatgaagcacgcatagaagaattgcggcgcaatgaaatggagaagaagaccgctattgtgcatgcgatacatgaatacaccacacacgaaatgtcacagttcttatccatagatgatcttgaaactctccatgagaacatagaatctctggcatacggacaagcggaactatataaaccggttcgttccaagcccgataatcaaatcaagtccccctcgctaagacattatgcatggaatatcggggagagacttgatatccctttaatcgacagggcaaagttcataaaaacaatattcccgcatgaactggaaaatgcgacaatcgaatatctttgtaaaaatcttcgtgactcagttcccgccataattgccatagatgtcccggagaacggagactatcatttcagttgcatgcaaacttcagtagatagcgataattagtttctgcagattataatctgcataatatcattatgttggtttgcagcatgtttaacatttaaatattagaacatgctaaacgaaaaactgacattcaatgacctgccggaagtggtaggcaaactttgcgaaagaatcgagagtctcgaaaatgcgctgaaagacaatcttgcaaaacagactccagccaaagaaaacctgcatgtccccatgaccgtcgaggaagtatgcagttaccttggaatatccaagtcatccttctattacaaggccaaacacggagggatacctgtcatcaagcaggggaagcatctgttcgtataccgcgacgaactggacaaatggctggagaccggaagaaaaagccaggtgcctctgagcttcgaggaggaacacgagcaaatgcttgctgcgacaagacataaggccaaaccaagagaaatgtaggaatatggaaaagacgagctgtaatattcctactccggaggaattgagaaactacataaaagaatctgtcataagcgtgaccgggacatacgaacagtccgcttccgtgcttatggtggatgattccacaatcgggactctgggaaacttcagtgcatccattggaaaggccaaaagcaagaagaccttcaatgtctccgccatcgctgcggccgccctgaagaatggcacagtgctgcattaccgtgcctgcttcccggaggggaaaaggaagattctctatgttgacacggaacagggcaagaaccattgccagattgttctgaatagaatcctgaaactggcaggtctgccgaaagactgtgatgcagacaacctgacgatgctggcactccggaaatattcgcccgaagtacgactggctataacggaagaggcaatcggcatgatacctgatttaggtctggtcatcatagatggcatccgggacttcatccatgacatcaattcacccggtgaatccaccgatgtgatatccaaattcatgcaatggaccgatgaccggcagatacatatccataccgtcctgcatcagaacaagaatgacgaacacgcgcgtgggcatgtcggcacggaactgaacaacaaggcggaaacagtcatgcagatagagccagacaaagatgacaagtccataagtgtggtgggagtcatacacagccgtgaccgtgagtttgaaccgtttgccttccaggtaaacgatgattccctacctgaaccggtggagtcatatcagccccagaaaaggcaaccaggacgcccgcctaaggaaccgttcgacccgtacagggaaatacctgaggattcgcaccgttccgcattaaacgccgcttttgaggacggaaacatcagcggctataacggctaccttgagaagctgaaagatggctacggacggctagggataaaattggggtacaacaagacggtggaattggcaaagttcctatgcaacaagcggatggtcgtaaaagaagggaaagaatacaaattcaacagagatttccattattgaacccctataccatcaaatcccggtgtgacatttttctgtgacatttcccggctttactttaatgcaggggtgtagatatgggaataaagcaaagctatggcaggtttcatcatacaggtgcaatctgccatgctcccttttgtatgtacactggaaatcggacatcctctgcattatttgaagtgaggctatcatccatgccgggcttgcccatctgccagtagtaaaccctatgggggagcctaataccccatttagtgaaaacaagagcaaaacaagagaaacaaagtcaaataaaagcaaatgaaaacattgattattagatatttaatgaaatacggcgtttcgataaaatttcataatttctcattggtgtgacatttttctgtgacatttttcggaggatttttctacctttgtgccataaccattcaatagtcagttatggcaaaggcaacattatcactctcgaagaaagcaaacccgcagggcgagcacccaatattggtacggctggacatcacacgcaccaaccgcccgcagttcaaatccactgtcaccgtcctgccggaatatttcgccgacggcgaaatcaagatacccatgcgtgggaaactcaatgcggcgttccgtgacgaactgctgaaaaagaagacggacatagaggcgttcatcgcttccttgaccgccatttctatggctctgccggaagaagcccgtacccgtaaggacatcctcgaagtgtacgaggttgtcaagtctgtaaaccccgccgagataagccgcacgaccatcatcgccaagaaaaaggagcagaccgccgccaacgccgaactcgtccggcagttacaggaggcgcgccgccccggagtgctggactttgtgcgcaagcggctggagggcatgaagaacggcacgataaagcgcaagggcaacaactacacgaaacagacgcttcacgcttatacgggctttgccaatatcctcgagacattcataaaacaacaccctttcgactgggaagacatcaacgagcggttgattgacgagtttgtcctctacatggagaactacggctacatgaagaagaccatcaacaaaaacctcgctgtcttctccgccatgctcaataccgctttcaaggagggcttccgcttcaagacatcggtgctcgaccatttcccgaaactccacgtgacacgggaggacaaggtggtggaaatctacctgacggaagaagaactgcaagccctttatgaaatgcctttaagcggaaaggaagacaaagcccgtgacgtgttcctcgtgggctgttacacaagccagcgtttttccgactattcccgtatcacggagcgcaacatcagcttccacgacggcgtgggcatcatcacgctgacacagcagaagacaggcacggaggtttccatccccatactcaatgacaaccttatccgcattttcgagaaatacgactacaatctgccgtacatccacaacaacgacctgaacgaaattatcaaggtcgttctgaaaaagctctccgaatccgtgccgagtttgaggcaggaaatggcgacaaaaatcacgctcataagccaaaggatggaagaacagaacagggtagcgttcaaacgcaacgagtatggagatatactcgtaccgagataccgcctcgccaccacccatacagcacggaggacgggcatcaccctcatgtacttgagcaagatgctcgacagccacgagatgatgtcgataagcgggcacaagaccgaaagcgttttcaacgattacatcaagataagcggtatcgaactggccaccagcatagcaaaaaaagtggcgaaagccaaacaggaagcagaggtcaaatcggtactgttggaacagttcgggcaaatgtcggctgaacagcttgccggacttctcgaactggcaaagaccggtactgccggataaccgttataaccataggggcttatgaaagaaaacatcgaagatataagtgcggatattgaactgcaatacggacaaccgaacatggagcgtaacatcgcctatgtcctttcacttgtcgaggcgcatgccacggaggacgggagactggatgatgatattcccgttccgtccatcgaagcggcggcaaagaccatcctgctgctgattgaccgccccgaactgtcttgggaaacgatctgccgggaacagcgtgtgaaacacgtcatggaatacctttttatccgggcacgtaaccaccccgacgaggtgcacaggtttgtcgataggctgctcaaacaatatgtgccgaaaatgccgtcgcaaatggtacgcatctacctaaatgcgtggaaacatattgccggacaatcccggccgacaaagttcaccgatgaaatactctacccggaacatgcggagaaaattctcgacacgctgcattttttgcttcagggcaaggtagggcgtggtgctgcacttgtcatggtatgcgcaagggacgagggattggtacgggacatagcccatgcgaaaatcgttaccgagttctgccatgtgacgaagaccgcctacaacaactacctgcacgagcgtttccccgacagggagaagaaccgcatcgtcggaacgctccgtaccaagattggctacacgaaagaggaagacggacgcattgttttcctgcccgacaaaccgagctacaaaagtgtgttcctgcaactgtggcgcatgatgaaatcgctggctgaataattttccttttccctctttttcggttgttataaccgggcagggggataaggtgcgggaggtcatttgtcgtcgtaatgcccctctacggtcaagaccaacacggtaactttctcctcgtatatatcataaatcaggcggtcgttttttgatattcttctggaatatgttatcgaatctcctgatttaagtggttcggggtgtcccgtccctgtcctcggatgctccatcaactcattaagcagcttgacgagcttcttgtattgcacgggattggatttcttgtatttcgatacagtctttgtcgctatttgggtaaattctatcttatacaagctcatagcgtttccaagaatttattaagttcttcctttgtagtacaggtcgtgacattgccctccctatattgcctgcgaccctcttcgagcctctcttcaagctccggggaaaggacaaaatcctcttcgtaaacgggggtcagcatataggagacctttcccctgcgcctgattaccacctgctccccattgtcggcgagtgcaaacatggatgcctgcttctcccgaaattctcttgatgtaatctgaatgactgccataacttttataatttacattgtgtaccaaaattggtacacaaatataatgccttttcccgaaaccgccaaactttttgccaaaaatcagtcttacgagtgcgtttcccctctcatgtattgttaattccgttcacaaaaatgtcttccggtgtccggcaagcaatgacaacccaaaatattccgcattcgtttcaaagcgttctaacttcgcaccacgaatccgtggcagacctcactgccacggtgcagtccgggcaggtgcgaggcaaatgttttgccgtgagggtcgccgaaagaactgccttgtcaaagaaatgacttctacacatgatttggaatcaagacaacccgacacgatagtcatcacttcggtcgatacattgaaaaccgctttcctgcagtggacggaggaacaggaacgacaacgccgtgcagccgaaaaggaggccatgctcgacgaggaaaccgtcctgcaccgcctcggcaagagccgggccacgctctggcgatggaacatctccggctatctcacccgttacaaggtcggcggcaagaactgctacaaactttccgacatagaacgaatagagggaggacacaaaagatgaacgtggaacaactgacagcgagtatcgcacagcgtgacccgctcttggcaaacgcagtcagccaaatggtcggctatattcaggacaaatgggcagcaccatacccaaccaaaaagcagacggagacagtcaatgcctacttgcattccgtccatgcggacggtgacggcacgatgaacgagacgaacatcgcacaccgcaaaattgcctcgcaggagataaccattaacgcaatccgtgtgcttgaccatgaacaactcgaccacttgcaggacgtgctgaaccacatagcggaagacagagagttttacatgcctgagcgggaatatggcttgggcaggtagcagaccattgtaacatcataatatcattagactatgtacaaggataaacagacgatacattactgcactattctttcagccgggcagtgggattttcttttggaaggcaaattttccgctttaaggcaaaaatgcctgcatcggctgatgtccgatgcggtgcggacaaagaccacttataaaatcaagggtattgaaatagtcttgggggtgggacaggtcgcagcttccgacgtggaactggcggaatacttgggctgcaaccgtaaaactatcggcaaactcattgacagctttaacagcctcggtatgctgaccacccgagccaacaaccgaacttccatacataccctgcattttctgacaggctggtatgtcgggggtgtcctcgtgaccaatccccattatgtcagaccttcggcaaccgacaaaggacagacgggcgatgtgcggacacctctttccgttgatttgtcattggaagatagccagtgttctgtgcctgacgatagccaaagcgaaacgacaagtgcggacagcatgagaagcggggaaaccgctctttcttcttccctttactcgcctatggcttccggctgtcaaattggcaagtcgtgcgacaaggacaaagccgaccaatcctctatcataaacagaggggatagaagaccggacgacaacggggaaggaagccccaaagaggcgcaggacggcacgattggcgatgaggatagcccgagcatagggaagagaaattgaaaggtgcaaaacgccgaatttcaaacgagcctcggttggcgtggagtgagtgaccgtgcttgcaccggtatagcccactataacttctccgctgcgctccgaagttgtgggctctcccgaggggctgggcgttgccccgtcccacttaggacgctgccctaagaacccggcaagggcggtctgccctgtgcaacccgaccaaagagtgaccctctctttggaaactccgcttagaggttttcacccctaagaaccccaagcaggaagtgaccctctccctgcacccaccgattaaggcgaagccctaataacccattgtgaaactaaaaaacaagcgaacttatggcacagaaaacatctatcaacataaagccttgtaatgttggaagcagcagtccgcataacaggcggtcagcggaatatctcgccaatatccacaaggagaagctctacatccgcaccgacctcatggctaaaaatgaagcgtgggtagcacctgaacttggcgatacgtcattggctgaccgctacaagcagatagccgcaatggtcaaggagaagacaggccgggcaatgcagaccaaagaccgagaacgggtgaacaaaaagacaggcaaggtgaccattgtgcgtggcagcaccccactcaaagagggcgtggtcgtaatcaaggaagacaccacgatgaagcagttgcagaatttctgcgaggtgtgtaagcagcgttggggtatcacagcattgcagatattcattcacagggacgaggggcactacatcaatcccggagacactgccacatggaagcccaacctgcacgcccacatcgtatgggactggatgaaccacgacaccgggaaatcctgcaaattggacgagaaagccatgagcgaaatgcagacactattagccgagtgtttggaaatggaaaggggcacttcaaagaagctgacgggtaaggagcatctggagcggaacgactatatccttgccaagcagaagcaggaagccgagcaagtcaaagcagaaagggaagccgccctcgcagccaaaaagaaagccgaagcggaaaggctcaccattgagggagagaacaaggaaaaagagcagtacggtctttcactcgacaacgagattgccgacaaggaaaagcaactcaaagacgagcgcaaggcgaaaatggacagcattttggatagtgtcggcagcattgtaggagttggcaaatccgcagccgttgaaaaggaaaacgccaagctgaaagccgagaacgagcgcatcagaaaagcctttcccaatgccgtaaaaaacaaggtggaggaactgacaaaagtattagcctcggaaaaacaggaagccgaaaccgagcgtgacagggcgttggcactgaatcgctcgcttactatggaacgggataaggcagtaaggcagcttcaggaacagaaggacggcgagcggcagcgcatcagccaagcggtacttgaagccactgaggaaaaagacaagactatccgcttgctgcaaggtgcgttaaaaaacagcaaaaggattttgaacctcatagccgacatgctgtatcatgcgagcgaggtattcaaacgggctgtcatggcgattatccatttcggaacggagcggcacaagtcaatctttgccccgtccgaagccgccgacattaaaagcgtcatgcaggaatacggcgaaacgcccgaacaacaaaaatcaatcggcgaatggctgtgcgactatgcggaaagccgacagtcttttgacgaaacaaaacatcggcaaacccgaaacgaggttgccgatgtagcgtatggggcgtatgactggaaaattcggaaagagagcgatagcctacaaagatagtgggtgacatttgaaaaaatagaagccctccaattcgagcattttgcgtttcgcttcaagcccgccgccatagcctgtcaaagaacggttgctgccaatgacacgatgacagggtacaaagattgacatcgcatttgcgccgttggcattggcaacagcacggacagccttcggcattccgattcgccgggccatttcaccgtaggaaaccgtcgttccgaaagggatgttcagcaattcgttccaaaccgttttctggaaatccgtacccacgaacaacagcggcacatcgaacattttgcgccttcctataaagtactcgtcaagttgaagtatggctttttcgatcacatccgatgtcccctcctcgaactccgcatacaatatccgcttcaaccgtctatccacatgctcatgatgtttttctacctgccagtcacacaggcagagtttatctctgaatgagccaagcaacagcacgccacaaggggataagtacggtttgactatgattttatttttaactttcatcgtttttttcgtttgttacttgctttttcttggggtgcataatctttcagaccttccactgctccggcagacaccgcccaaaggtagatacacgccacgctgccatacggtgaatagcggcggcggtatttctcaaacagcttgcgggtgattttgcggtggtggtacagcatccgcaaccctctctgcatagccaaatccccgaaactaagaatatcggggcgttgcagggagtggagcatcatcatttccgcagtccatattccgatgccgtccaaagccgacagccgattacagacttccgcatcagccatgccgtgcaactccttgatgtcaaactctccactgatgattttacgtgccgcactttggatgtaatctgctttcctgaacgtaatcccgaagcgttgcagttcttcccgtggaatggaggcgattgctgccggggttatcgttccgaagtgggtgagcaacttttgccaaatcgtttcatgtgcccttgttgaaatctgctgcccgacaatggaatgaacaagcgcagcgaaaaggtcgggaatgacccgccttttcaccatgccaaccttgtctatgacttccgccagtcgtttatctttgcttttcaggtaagacagttccttttctccgtattggaaatacttttccatgtcattttacattcagaaaagcgttggaatctttcggggcttgttcccgtttgttcattgtatattcacggataaccgctgccactgaaatcttatatttctcgaaaagcgtgtcatgtcctttcttttggctgttgcggtgattgatttgattacgccaacctgccgccgcttcttcgctttcccatactgaaaggcttaacagcttgccctcttcattcaggcttgcgaagcgttccacgctgatgaaccccggcattttcgccagttcggatttcagtgcagcacccagactaagatattcctccttcccttctttttttggggttacttcaaacaatacggctactttggaagatttgggcccggcggtcttagcggtcagcccgttcaactcctcaaggctcatcgtttcgttgtacatgcccgcgcataccgtataacgcattccgggaataggatatatgtaagaaattttgcgtaccctttctgttgttcccggcttgggccatacgaactctatccagccgccaccctgcaaggcgacttcacaaaggcggattccgtaatggtctttattccagtccagatgttcacggatatttccgccggtcctttcagggaaacggggatttgaaactacaaggcttttctccacgtcgatgatgaaaatataatcgtctcccgtgttgaactccgatacagggtcgcttaggatcttcagccctgcctctccttgttgttttagaatttctgccgccttgtgtacgttctctatgacctgctgcggcgttacgttttcttttgtttccatattactgttgcttttacaaaatacatttagacttccgacagtcaggacgactgtcaataataacgctttcattttcatgattttattttccaatattgagattactccagaagcgggagcccaagtctgccgctgcttctctggcatcggaagcaatactttccgctactttctcatgcaaaggctgggattcgataaaatgagccgtatcttcatatatatgcctgtaactgtctaacaggcgtgtcgcaaccgagctgtaaagctcgaaaagaatttcattatgggctgctttagctactgaaacatggaactttatgtctgcttcaatacactctgccaatgttccggcttctgccgcagctttgcgtgccgcaagatattccatcatttcttccacatcctgcgcagtatggcgttgcgcagccctttctgcgatggcagattccaaaatgttccttacttcatacaattcttttatatccgcacgtttcaggcgttgttccaaaggttcttgggataatgacggggttgtgataaaagtccctttcccttgctgtactttcagataccccatgttctccagtttcttcaccgcctcacggatagaagaacgtcccacgccgaattccttcatgagttcggcttctatcggaagtttgtccccttctttcagttcaccgtcgatgatttgtttctgcacctgttccgccacctcatctgccaaagaccgcctttgaatgattgttcttttttccattgctattatattatttatattatcatatcatgatatcatctgatgattatgcaaagatatggctttcgtgttttacgtgcaagtttttttgcttgattttagccgggcatattggccttacaagaaatattgtgacattatagtgacatatttagaattttacttatctgtaaatgttcaaaatacaatatttatatatttgattaataataaattataaaataaaatcaatcagctatatattagtaacctaataccccactcgcctttcggcggcgggatgagtgccacttaaaacagcaagctgagcacgggaaaatgtctgtcgggattggacaggatacggaagattatatctctcatgtagccgactatgacacctgcattttacgcataattccgcaaaagaacaggtctggactttaatccagttattatttcgagggacttctgctttaggagcaaaagtgcatcaaagatacactagtgtcatctaaacgaaaaatcgtcgccaaaacatacaaaattattcggcagaacattatacattcccaagccgtgtctgttagatatgattctgattttgtctccccttttttcgaacatagttcacctggctatagtcaaactcgctacggaaccaaactgtgaatgtccaatgcgcataccacatctacttctactaagattggctcatgttatgacagacttctatcatgggttttggtaaacaaggtttctgcgactggataatccctgcaataaatgcattttgagaacccggcaaacactgaagcgacatctggcagagttagttaatgcatctgcacaatatgttcaaatcaacattgtttgaaattcatcccagtactttgctaaaactggcagcagcgtattaggaacagatgaaaagtctgattaaatctggacaattttatatttttaagactttgcctgaagtattttcattaccgttttctcattcaccgtatccgctgtagaaatacgatgcggacacaatccaaacttcgtaagtattcggtctttgagggcatcacgcgattgctgggattcgctttctttatggaaatgccaaccgtcaacttctattgcttgaagcggacgcttggtgagagagttgtaaatcaagaagtctacgtgtgagaaaggactttcggcaaaagttttttcctgttcatccaacacgccccagtctgcaattaatcttgacaggggatagtggcacaaaacttctgtgtttgccaattccaaatgagctatacctttgagcaacatattatacacaagatgttcagacaggtatccggatgcaaccggatgagcctgctcgtatgccaaacgttctgccgtatattgcttgtacaacaaatcaaaaacagaatggagcttgctctccttcacttcaaaattgttgtactggatgtaggcaatgagttgggctatgtttgtgtcctgcggcatatcgttgccattggtcactatgcacaaatgggttttggctcgtgagatggccacattgagcaggttggggtcatcggagaactctgtcggagcgttatcaaccatgctcatgatgattgtgtcacactcacgtccctgatacttatgcaccgtgctggcaatgtctgacccaatgactttattgatttcctctgcttgtgagcgataaggagtgatgatgcccacagtgcccatatccgcatattctggcatcacttcttgggttatcacgtcaatctcacgctggttgaaatgcccacgggcatgattccctttgattgtccgcaccacctgtaacaccttgtcctcgcctttgtctgtcgtcatggacaccagttcaccgtcatagaatttttgattgcagaactcgattattttcggatggcaacgataatgctcacggagcagcgtaaccggcgcgtccttgaacacctccacacaagattgcaagaaactgtgtgtggcggcattgtacttgtcatccacgttgtatgtagacaggatagcgtccaatgcctgagcttcttccctgctgaccacgttaggaagctgtttgtcatcacccacgattacggcattcatggcacaagacaacgccaacgcacctgtctttatgtccacctgtgatgcctcgtccataatcacatagtcaaaaaccatatccttgctgatgcaacttttggcggaataggtagtgctgagcacgaccggatattctttcaaaaactcctcggttttcggcttaatgtctttggtggtgaatcgtatcctctctgaggctcgatagcgttttgccatcttacttttcaacaccaagagagatgcggaacgcaattctgccgtacaccgtttgatgtcgatggattgcagcgttgtgacaatagcatccaactcttgctctatttcagtcttacgggaaaaataataggcagattccaaacccgtaaccacatccgacggcttgcctccgagaaacgagaatatcctcatacccaataaaaaagtccacttcagccgaaaccagatgtcagctttggggctgttctctatcttcagttgataaagattgagcagtttcatcagtttggaagaacgtttgtcgttcagccactcattgtcggaagattccagttgaagcatgtcattatacttcgtttctttcagcaatgcgtcgtattctgccttcaactgggcttggcgtgtctgggcatcaaatccttgggtcacggtatgaagcgagttttgtgcttgttgtctagcaggctcttcttttatcgcccaaccgctcatatccggataatcgggttgattggcgatgaaagcctctttgttctgcacactgcccagtttcgccacgataaagtcaagactttcctctgcaagtttttccgccacattctcaacggctgaattattgttcgacaccaccaacacagttttgtctgccagcaacagattggcaatgatgttcagaatggtctgtgtcttgcctgtacccggaggaccttggatgatgcttgtctgatgcatcaatgcagcttccacggcagccttttggcttgcattgcaaccgaaaggaaaaaatacctgtttaggctcacgatagactgccaacttcgtcttgtcgccaagatattgtgccaaaggcacgttgccgcgcttcaagtccaccaagtcatactgtttggacaaaatattctcgtcatcttcggtggtcagacccgtttctgcggccaatttccgcagataatcccaggtggaacctccatttttatcaagtggtgtacgggttacatacacatcattttcgtcaaagttttcagaataaccgttggcataagtcactcggtaaaaagtatgccggccatcggtgaagcgaagcaactcgcttacatctgttatatgcttattcctgacatacagtcccttttcacccatatctatcgcttccggatgcgtgagataaagcagtctggagtgattataattaaacacacggggcgaggacaagaaccgcaccatccaaaggccgtttttgttctcgcttatcgaagcgacttgttcggtgatgaacattcgcttgtcatcgcgtcgctccaaatctacaatcatacactgctttgcgtccatactatcacggatttatttgttgccaactgcgccaaaatcggccagcatacctgaacctaatcctttaatatgacctttataccaagatgcaagacctcggaaactttttctatgaaagcctttttcattggattgttgctgtgagttattagcagccatcctccacccaaatcccgctggcttcggccatatttggcatcccttcgatttgaaatcactggaactttacaaaacttcaagttatactcttctaccacttggcgcacttttgcaaccccgattttctgcacgaccgcaaccagcgtttctgcggcagtcttttcagagatgacagttccatccggaaattccacagacagatctcttgccggacctcgctctatctttccctctgaacttgagaggtgattccgatgagttacctccggatcaagcaccatttccttggcatcggttaattccgctgcaaaattacgcttacggctcaaatgaacgctcaatggttgtccgggcacataatccactaccaacaccaactcccgctttacgggctgcaatgctggctcaatggtcttgctcaacaccggaagaatttctttcttgatgatgttttcttccaattcattggccttcttttcaaggttctcatctactggaagcccttctttgcgaagggtttccatggcttcgtatagtttgcttaatctggacatatttaaattattaacatagtgtataatctttatgagtactaatctcattcactctctatttccttatatattttgtattcaaattctaacaaatggtttatgtcttcatctcttctcaccactcttgtaactctaagtgcagcaaatttatgattgcgattctccaacagcacaatttccccaacgttaacagacttagcccgtgaactaaaatcaaaattaataaactcgttaggagacggaaattcagtataattaggattatatcccaatctatatatgtaatctctataacaatgaatagaattatgcccacattcactccaatgagtaacaaatatataatcaccttcccctatagtatatgaaccactattcctcttatagtcaaaggatgctttcccttcaaaaacagggttttggaattctatttgttctatactaagttttgttgtaatctggtctgatattattgatgaaataaacggattactcccaagtggcggctttttctttatatcctcatcataaatacgttctagaagttcttgatagttatcataatactgaccattatcaaaatctacatactttaatcctgaaagaaatgttggaagtttacgtacttggaaatttcttttgattactggaataataaatcgtttatcatcattatccatcatttctgctgctaagattcgtttttcatatccggcccctcctattccgccattagctttctctatatatttgtcactacacacgcacaatacaaaatgagatgttgtaagcccttgctccataaagaatgacaaatcgttacctaacctagcatcccattgatccagtattgcatcaattccatgatgtcgtaaatcagatgcgagttttaacacccaatttttatgttcttcattatcccaggcataggatataaatgctttcttaatctctgattccatgtttagtaattattcgattataattgatatcatccaagattgctaatctcaaaattttaagacataactattttattaaattacttatatcataatcaaactcttgtaatttcagcgcactatcaatgacgaaatcaatacaaaatcgacaatcactcgctcgcaaattgaatctgctttcatagtagtcttttggcattgaacgatattcacgaccaccattgccccaataaacatttgtttctggagtaatgtattcaaaaaaggcatattttcggtaatcaataccaagagcagtaattttcaatatctcacgtatccgattagttgtttccgtaacatcacgaaaccatcgttcgccaaatttttcatcatgtccaataagtttttgatactcgctacctatttttctgcctacatcagttatgctatttatatgatactttcctcttttactatcttcataagatgataacaattccataaatgctattttagcattcaccatacaattgtagagatcattttttacaagatattcttctgccgcatcaatgtatgtttttacttcgttatatgaaattaaagatgatacagatactgatgaaaaatccagccaaaattgtattttcgtattctgacttaaaaaatcagccatagttatacgacttatttcaacatcactcttagaagggaataatcctttatgttttatgttaacacgcctttccttaagaatgcgcattgattccttaagtgttaattctggaattttgttccagtaatccataaatacattttctcctttcattcctttattttccgcaaccaaaagaagaaacatctccgcacaatcatgaaatgacagaatcgaaaagcctgcaaccatatcaacttgcattgactgttgcgcgccgagattgtacaagtacttaataattgccaatctcctgataattatttctttatcaagattactcatatatttatgattcgtattgttcccgtgttatagatgtttgaggatcgactattaacacttcatcgtaagtaagattataaagatgataaattaacaagtcaatttgttgttctaatgcagttatgtctgtgtccactgctaaacgtttagcattgaatatagaactgactaaattatctatttccaaaaaatttatattcactggtacacacatacatgagagataaggtgctgtaaatggcaaataattaccagacattctcaatccctcgaaatagcactcatatatataattaaataatttactatgtatccatcccattaactttaaaggactaacttttatgctatgcagacaattggtattgattgatgcatattcacctttctcgtcaaaaaagccttcaagacggagtgacatttttgcaattataattttgggactattataaagattatatcgatttatccctaatatttttgcattattgggtagcattgggtataaatactgttctcctttgtcagtcaaagtgcgagctccccaaaagttacaatacggatctatcgttcctgtattgataagtttgagtcctattttttcatcattatataatgaattgtgaaactcgtctgcttcagaagcagtagatgttgcattgatcttacaaacatctaaaattgatttacttttaagaagaatttttttggttaatttatacttggtgctaagtatgaacccccaattgttttctggtaattcagatagttgcgaagaattgaatttatgctcaattttatatttgtcaatagctataaactcataagttttagtatcagaagatttgcgaataatactaacaactggatatgtatcagcatcaaaaacactatcccttgaaacgtctaacacagttgttatttttgcattagtcatcaagtaagcacgtaacgttttgccgtaattggctgaaagatatttgttaggagttataaaagataatgtaccaccatcacataataagtttaggcctttttcaaagaaataaacatacatatctaccgtaccttttgaagtttggaaaagactttttaagtacttgtaatttgtattaccgagcgattttttcaaatctatagcacttatatacggcggattaccaatcacaatatcgaatccttcttttacgttaaacatccattcaggatcgaaatatggtgaagaggcattttggttgaacatgtcccaagcagccaattgctgagcttcagcattacccacagcaccacaatcttccaacatattagctattttcagacgcaaatcgtttacaatctgccgatatttacgcttggtgcgtacagtctttgccccgaagattttgtgcttggcaatcttcaattcactttcttttgcctttatctccgcactatcaaacaaagatgcatctttcttatccaatcctatcaacgtattggctgccacaaatttcgcttcaaggttcgggagcggacgaatgccaaagttttcaacaggattatcattggatttctggtcaacgaccaatgaaataaagaagcgcaacttactaatctgaatggcgataggctgtatatcgacaccgtaaatgcaattttcaatcaaatagagtttacgggcataatctgggcggttgacactttcatcaaaactacgctcgatgtccgcaatgatttcccggcgttcatcagaagatgccgtgcgataggcatccgatgtttcatcaatagccttattgagcatcatctccttccattgcgtattatcggggtcaatacggctaagaatatgcaccatctgttgcagcatacccatagggaaagctccagaaccacaggccgggtcaagaactttgcagttatagagcgattgcatgatttgttttcgctgctcttcggtaaagttaacaacctcgtctgtatattgcatcaattgacggtattgagtttcaaggtcatcacccacggtgcgtttgaggtgagcaaccagactttcgtccaccatatattgcacaatctcccgaggggtatagaacgagccggtctgttttctggctgtagtctgcgtctctggattgtaggatgcaagcaggttttcgaacactttgcccaacaattccgggtcaagtgatacctccttgtcgaatggtgtattttcctctacggtaaaattgtaacgtttcagtatatcaattattcctcgggctgaaactttcttctttttcttgtctccgtaccattccgacaggtctatattcttgccgacctcctcgccaaagaaaagataatcaggaactatcaacgctttcttcactgcttctcggtcactaaagccatcataatacaaatccttgtctttctcatccaaacaatcgaacagtcctccgttcaagaacggaaccgtcttgttcgctaaatcgacaaacaactgcgggttcttaaaatagtactcatagcgcatcagcttgttgttatcataatccccacggccttttctgaaatgcctctctgaaagctctttacttccttccggcgtaataggactattgagcatggcaaagaagagattctgtaagatggctttgtaatacttgctttcatcggatttataaaacaaatcaacttttgcatgcggattaaagctcgctatcagattgtctgcaatatatttttcgtcaaaaaactcgtcaggcacaaggtggcgttgcttcaggaaccaaacaaaaatcaagcgggtaatcaggcggatggcactctcattgttaaacttatcatcatccgtcttgtcgttaaggtcattggggaaacgtatgattttaatggcccaagcataccaatcgctcaactcctgatagaattcctttgtaagcacctcgacagagaaacgactgcgcaaatcttctgcattgacaacacggcctttttcattcaggtacttgttgggggtgtaataggcaatgcctttcccgaggaaataactataccggcgtgggttgctataattccgtgtgatacgagccgagtcatctttcacttcgagcgtaatctcaataagcgaaaagcgatagttatcgttattatcttcaggaacaaagattaccaaggccctgtcttccatttcgtcggccaacatgcggaacgcttcttttgaaagcgaaatacgggcatcattctttgaattgtgttttacctcgtacaccaccaggtcaagagtatctgacgaacccaattttatagcttgggtagtatatttcattttggttctaaactccacgggggttgtagatgacataaaatcctcaggtaaaaaactgttttgtagaaagttgacaaactcctgtcgattatatattctgttaaattccattttgagtctttttttattgtaattcttcacttaaaatcaatgtctcttcaccttcatccaccttgttttggctattaatcatacgtgccaagtattcagaggagattctcaacggcaattttgcggcatctttgggaactaattgattgataaatcttatctcatatcccgacaatgcatcagccttaatgacctgaaccaaatcagacaaataatccttaggcagtaactgatttttcatcaagacttttactttggccaaggcatttatcaactctttctcatttcgctctgttacatcgctgctgaataaagaggctttcaccttttgatacacagcatcgaaatcacgagtgaaatcaacaggttgttcacttttatctgcatcaaaaagcgaaatcgcctcttcggctggaatcattaccggactatttatcgtatctcctatcttaaatacaaaatcgtctcctttacgcccgaacatcaatactccttttcttggcttcttcatattacgtgcagtccttgcacgatgtggaagctccatagcctggtcatacgcatcggtacctttcaggctgtttagcaatttacgataaggagtatcccacgatgcttcctcactacgggcgaattccttacggtaacgttccttaaaataggcttgcaaatcttcttccttggtaagagcctttgtatcctctcccataatggcgtgaatcatggccatcttaagcgtagaaatttcctttgtcctggtctcggcttcacctacgtctgtcggaaaataattataaatgtatagtttatcaaacacctttttgttgatacgattaatacgacctatacgctgaatgacacgagtcgggttataaggtatatcgtaattgaaaatcgctccggcacgatgcaagttatatccctcggatatggcatctgtcgccaccaatatgtgataatcgttccgttgcaagatgggttttagtcccgcatcgaaattggcgcgaatacagtctttattggccgaagtggcatccgccgaagtatatttcatcacaggaagtccggcattcgcaagagcttcgcccaggtaattcaccgtatcagcaaattctgagaatacaaccaactttctgttcggctcattcttcatctgtttgcgaacaatgtcaataaacgaatccagcttagggtcagatttcaccatattgtctttgccaaaccactgcacacgcaaattcttcaacaactggatatcagcctcaacatcggtcacgaaatcatccttcacatatttcatgtctatctcaaagaatcctcgatcttcatatttctcgaaaagttcctcaatctcttccgttccatcccctcccgactcataaaaagcctcgacatccggcagatttcctttcttaaataccggaatcttatggcgcttctctatccaacgaagcaaatgctctgaggattggatcatatatcccaatgatgcctgaaatgccgcaaccgaactctcaaaacgagcgaccaataaatggcgcatgaagctcgatatgtttgtctgtcggccaagcagaagattgaacttgacaccggtcttatcttcaagttcctttgccaatttgtctttcagttcttcgcgtatataaaggacaggtgaatagcgggctgccttaaaacgataaaccgagtcactgcctccttctgatttactaattctgtcaagagtagaaaggtacaactctttcagcccactcaaatcatattccaattcttctggatcatccggtaataccagctgaatattctgttgctttaaattattggcatattccggtatatcctgcaaatccaaccgcgaacgacgtatgaccaaaggacttataattgagcggattttttttgctatgtcatcaacctctgccttaatctcatcatcggttatcttttcagccttttgtttctcacgcaaagtcttatacctgctcattaaatccttaaatgatgcccctagattttcaacggttttaagcgtagaacaagacggtatctggaacaacttgatcatcgcataaatgtccgccggttgattgttaaaaggggtagccgtaagcaataacactttatttcctgaacaaagattatgtaacaaggcataatcctgtgtatattcgttgcggaaacgatgagcctcgtctataattatcaggaactgttccccctctttggacaactcttgataatataaaactgcatcctcaattttccccgcactgaaaacggtagcggtaaatccgaattcatcacgataaccttcccactgcttatacaaatgcggaggacacacaattatagtccgtaatctcaaattacgtgcaatggtagaagctatcacacttttgcctaatccgacgacatcggctatgatagctccattgtgattattcaacgcattcagagccatttgtacggcatcagtctgataccttaaatttgaatacttcccttcggttatatcatacggagtcaatatattattggatgtagggatattgaagtattctttaaggactctgatatacattagataaggtgagtaaattttatcgtaccagatacgagtcatcactttattattccaatcatccagaatgtccttgctcacaatcactacagaagtctcccacagctcatcgaagagtcttttaccctcgtcataatcttgtttgtcattgaagcgggcattcaactccaggcgtcctttcaacccttgataggacagattacttgatcctgtaattaagacacctggtaactctccaccctcattcactaaatcgttataggcgaacaaatacatcttagagtgacaaggttcaagtgttttacgtatttcaagtgtgccatccagaactttcccataaaacattttgaattgttcttgtttttcagccgtatccaaaaaatcagactcattaatcaattttacaagctgttcataatattcttcttttacagcaccccgcgagattaatctttttcgaatagcctcaacctcacaaatatgaccggatatttgtaaatcgacatccaatcctaccaatatccttatttgtttgttcttcagattatccgataactgtacataaccggaaaaatagaaatagccaaccaatatgtcaaccgcatttgtcttaggcaatatgccattgatgatgtctgataagaatttttctttatttgtaataaaactgctgctcataatgtcatgatataaggttatttcaacgcatccaaatatgccagacctttttcagtcaatacatacccccctgtctttagcgagccttggtactctattaaacgcaaaggatcagaagacagttgttttatgatacgctctaatgttgcctttgaaatatccatcagttccaataatgcttttctctttatatacggagacttggagatttccaataaaacagacaaagcatttttatttatagcctcatttatagcctcatttatagcctcatttaatggctcgcgcgcattttcaaacccctccctgcaaggaatctcaatcaaaaaataggttctgtcctcatccgtttcaatcctagcaggctctgaaccgttccttcgtaactcatcctgtatcgtaggaatacccgttgcacgaccttctgacaactgaagttctttcaggtagtcacccaaacgacgattgcggtagcggcgtgacttcagatgttcggctttatgaatggcatccagactgattgaacggtccggtcctgcataactgaggatggaaatctttttcggttcgatggttatctctaccggttcttgctcctgataatctctatgataaagtgcattaacaaccgcttcctcaatggcctgataagggtagttgaagaatgtgattgattccgccttgtctttaggtttgataattcgctttttgattacattcgtccggatatagtccaaagtctgtttgatcatttccggaacaggccctactatcttgggaacttctatcatgttgtttggattctcaatgcacccttccgggaatatgacaatgtccacctgtgttgtaggaaagaatttcgccggattcttgctgaacatcatcgccgccacatttttaagtgtttgatgctcggtcggcccagtcaacaagtccatctgacccaatatttctacaaatggtttgctttcaaagtcatttgccaaacgactgcctactgtctgaagataatccaataccaacgccggagagatatccgaaatctcaatccgctcatttcctctttcatcaaaaggcgttctattagccatctccctgagttcgtcaagcacctcgccttttgcctcaatggtacttgttccgctgcggatataccatttgcttggagattgttttgccgtaactcgctctcttacattatacgggcggttaaccccggcaggagcccatatcacaagaacactcttcccatcaacttcttgcacatcaatacgaggcatatagtaaggttctatcttgttattgtacccaaccatgtccttctgtatatcgttcaatgcctcaataggcacacctgtaaccggtcttttggcaattcctgtccgttcctcttcctctatccccaccacgatatatccaccgccaatgttgtcaaaatcattggcaaaagcacagattgtccgatagattttatcaggattccatcctttcttaaactcaatgcggttggattctatcttgcgcttgttaagcaagtcttctatgttaattggtattgccatgctattggagataggttgaattatttttcttttctacataaagcaactccctcacatccacattcaggacttcagcgatgcgaaacaatgtttcgagatctggctgcgatgtgtttgtacaccaacgagacacagaacaagtatttttaccaatctgctcggacagccattttgccgtcctgttttgttcaacaagtactacctttattctatttagttgcttcatacagaaaagacttatagtttgatgcaaatgtacaaaatttgattgcaaaaacacatataaatgcaggagttttttccgaagtattttgatttataacacaacagctaaattttgaagattaaagtatgttgaatatgtttttctacgcaaaatattgctttttatatgaccgtgatttttagcgaaagctcgttaggataacaaagaggattacactttccaccaaatctttttcgccattttgtcaatatccaccgaattttccactcgcagactgatatttgagtgatgtttcatgaaaagcgatatgagaatagaatttatttgctaattttgcatcggtttagagacaatacaaacacgaacaatgcgtagatacagaatggacatattatcgatagcaacagcaattcagagcaataaacgcactgaatttgtgtcgtgtgtccatgtttcacgcattgaacctcgtattacaaatactttccaacgaacataacaagtacaatattgtactttgaatgagaatataagccgaatagttggagagtctttataaactttccaactattttgttttatgcccatttgtgacagtcgcctttgtgatactcttctgtcatttccgtctgatgggctattggcaaccaaattattaacatgcagtgatgcacataaattgagagaaatgaattttaaatttgatggcaacaaggtgttctttacatctgacacccatttttatcatgggaatatcatccgtttctgcaacagaccattcaaggatgtagatatgatgaatgaaaccattatatccaactggaataatacagtcggacaagatgatattgtttttcacttgggagatttttgtcttggaggttctgcagagtggacaaaaatgcttgaccgattgaatggcaggatatatctgattatgggcaaccacgatttgaagaatatacgccaaggttacattgacaagtttgagcatgttgcaatgcagacgcatatagaggtaggcaaacagaagatttatttgaaccattacccttttctatgctttgatggtggatataaagatgtgtggcaactgttcggacatgttcacacgagaaagaacaatacgggaattgatgcagcccggcttcaatacctctacccgacacagtacgatgtcggggttgacaacaataactttacaccggtatcatttgaacaagtcaagagaataataaccaaacaaattgagaaaggaggacagtagaatgaagatacaatatatgagcgacctacatttggaattctgtgataacagcaggtggatgaaacataatgaattgccggtaacaggcgatattttggtacttgccggagatatattctatttgaaaaacaagattgcacctctaagtaatttctggaaatgggcttcagcgaattatcgtcaggtgctcattgtacccgggaaccatgagtattacaattattgtgatgtaatggataatggattgcaatggaattggatgttcaagaacaatataggatattatcaaaatcaggtagtgaggattgatggcaccgactttatcatgagtactttatggtctcaaatttctccttccgacgaatattttgtatggaagggtatgaatgatttccggcagataatgtataatggcaaactgctccaaacagaggagtttaaccaaatgcataacttttgtttggatttcataaagcgaagtctggcagaaagcacagcagaacacattgtagtggtaacacatcatcttcccacattggaggttgttgctcctcaccatagaggttctgtgctgaacagtgcatttgctactgatttgagcaaactcatagcaggcagtcgtattgatgcgtggatttacgggcattcacacacaaatattgatgctgaaattaacgggacaaaagtcatttgcaatcagatgggatatgtatttgacaacgaacatatcagcaatggttttaatccgggcaagtgcttaatcttgtgacaagcagattcatctaacacgctctaaggcctcaatgtatcatatagttaatagaaaagcacctatttcaatattatatgatacgttggggcttaatattttcagttagtcacacgaaaaaaatcttgcttgtcaaaggaaagttacctttactttatccttgtactcatatatacgcctaataaagtaaagtcagaacaaagggaagaaaagagatggcttcgccaagcagaccaaccgatttacctaagtccacacacgacacaacctatttttcttttggctgcaaaaatattcgtgactgcatcttgtttttagttgacttcagttggtgaaattaccacttatttcgtatcttcgcaccagatagaaaacaggtggacttcggacggggaaacggcagttttcccgttggttccgattcaagagaaaagaatggcaaaaagggcggttttgggcctgaaaaacaagtgaaaaatggcttttctaccgtttaaacgccaattcttttgttttcaagcagttcgatatgctcaatcgggaaaatgatatatcgcaattaattgtaacgaattagaaccaactataatgaagccgctgattttcagtggatttttatttgtctaaaatccggctatatgcagtcggatatagttgtccgccatatttttctaccgtatttctactgcgaaactttttcgggatttgccccgatgttacgatgacgcagtagttgacgtgtgttgacaatggtttacgtgtgttgacacaaaagaggagaaataaagagatttgaactcaaaatatattaggaaaatatggaagtaagaaagcatacaaggactgtaaaaaatcgctattctcacatcatttgcacttcccgcataccccctttatcagcacctcgcattcttcctgctcgaaacctgccggcaagacgtattcctgtaacggaatctccttgaagcaagtcaccgcatggcacatcttgcaataaaaatggatatgactatggctttgcgctgtattcaatgcgtatttcaccgtcgtgctgtcgatggtaatgcgatgaatcacacccttttccaacagtgtttgtattgttcggtaaaatgtaatccggtcatacatatctcccatttcgacctcgatgtcgctttccgtcaggggaatttgcttgtccaacaagatgttgataattgatatgcgctgggcgcttttcttaagccctttctctcttaatatatctattgcactcatctgtcctaatttgattgagattgcaaagatacctaattatctgcaagacaaaagcacgtgataccgacaattaggtattttgatgtgttttaaacagatgaaacaaagtgttaatatgaaacattgttgcttttatgataaaatgcagtatatttacggcgattttcaataaacaagtaaaaatgagagtaaaggcaaaaagcagaatcgtagtagcatggctgttgttcatgacgctcatgcccctctttgtggtgaaggctgtccatcatcacggagaaagtgagactgttgtttgccaatcttctgacggggagcactcccacaatccttgcgaccaatgccccgtctgccagttcgctctttctccgtttgcccaggctgaagcctttcatgccgagataatcgtttcggtttccgattacaaatccgtttatcgggtacagagcataagctggcggcttattcgctcgcatcacctgtgcgctcctcccgttttgtccgcactgttataataagtgatgtggtagaaagtgccctttgcttatgaataatccgcatatgccctgtccggatgccgggtgaggcatatcctattcccacaaataatctgaaagatattgatgaaaaagatcgttacaatccttgtgacattcttgttcgtcgtccacactcatgcccaacggcaagacaccgttccggacatgacaagggatggtgcgacattgaatgaagtggtcatcatgggcaataacagccgcaaagacatgctgatgaaatcttcgcagagcctggtgcgcatcgacaaatcggagatagtatcctcgctctcgggtagcctgatgcagagccttagctctataccgggagtaaaagcgataaacatcggctccagccagtccaaacccgccatacgtggattggggttcaatcgtatggcggtgaccgagaacggcatcaagcacgagggacagcagtggggcgaagagcacgggctggagatagaccagtttgcggtagactgtgtggagattatcaaaggtcccgctgcgctgctttatggttcggatgccatcgggggagttatcaacctgtatagcgatatcccgccggcgaagcccttcgagggtaagaccgaactgtttatgcgtagtgtcaatgaatcgttagggctttcggtccgggtggcgggaaagaacaattggttttattacaaagcgaacctgacgctggtggattacgcagactataaagttcccaccgacagcatccagtattattcctattacatccggctgaaagaacaacggctgcgcaacacggcaggcaaagaacgcgacggaagcctcctgtgcggttatgcaggcgagcgtttctctacctccttccgcatctccgacacctatgtgcgaagcggattctttgccaatgcgcacgggctggaagtacgcctctcggatatagactacgaccgctcccggtgcgacatcgacctgccccgtcacgacgtcaaccatctgaaggtgacaaaccattcggcatggcgcaccggagcggtccgctgggaaagcaacctctcttatcagaacaatctacgccgggaacactccgaaccggtgtcgcacggctatatgcccatgcctcccggcacgctggagcggaagtacatcaagaacacctatacggcaagcctgggcatgaaggcgctgatagctgaacggcacagtttgaacgcagggctgaatgtagagcatcagcataaccggcgtagcggatggggattcattattccggactttgaaaccacctcgtggggaggatatgccttcgaccgttactttctgtccgacgacctaattctgaacgctggcatccgtatcaacagggtcgtaactcgcatccacagttatcacgactggtacaagacgccggttgccggaagcgattccgtctatcgggagcggtcggaacggcttcggaggtctttcaacagcttcacctggtctctgggcgtcaactactccgctggagcatggatatggaaagcgaacatcgggaaaagcttccgcgtgcccatcccgaaagagctgggcgccgacggggtaaattaccacatcttccgttatgaaaagggagaagccggtttgtcgcccgaagaatcctaccagttcgatgcaggaatctactggcacaacgaagcgctcgatatccggctggactcctacgtgaactatttccccaactacatctacctgaaccccacttcggcctacaccgagggcttgcagacgtattattacacgcaaagccgggtgatccgctacggggtcgaggcggacatccgttaccgcttccttcgccgtctggaagccgtggtgaaaggggaatacctctatgcggagcaactctccggcaacaagaaaggatacaccctgcccttctcgccaccctggagtgcggatgtggagttgaagtacaccttcggctccggggaggacggtgagacggggtttatctccgccgcctaccgcacagtgggcaaccagcatgagattgtcccacccgaaaagtctactgccggatatagcatactgaacctgtcggcaggaaaagtctttgcatggaaagagtgccgcctgcggctgaacttgcaggcactgaacctgctgggcaagaaatattacgaccataccagttattaccggcagatagacgtgccggagccgggacgtaatttctctctgctgataggatttgatttttaaataataattcattaacaaataatggaaaggcatgcgagtacatccaagtgccttccctctaaaaacaaagaagattatgaaaaagagtttattcatggcagctgtgttgctgctgagtttgtgcatgtttaccttctccgcctgcgatgacaatgaagaagataaaaacgtaggaaaaccggttgtcgccttgaacgaagtgggcgaagagaacagtaagaccgccattgccggaagcgaccttcacctggaggacgagattacagccgagaacaggataaagcgtatcgacatcgaaatccatcaggaagagggcggcgagttccgcatcgaaaagtcgtttaccgaaggaaagtacatcggagtgaagaacaccactttccacgagcacatcgacatccctgccgaagcgcctgccggagcctatcatctgcatttcaccgtaaccgaccagctggggcaaacggagatggcgcaatcggaactggctgtgaaagctgccgctgcacatatcacggtagaagacttaaagttcggagcgtcgcatgatttctcggagaacaagattagttatgtaggcaccaagccgatggtatccgcccatatcaaagcagaaaacggaattgaaaaaatcgctgtctttatccacaatgaagaaggcactcgggcctttgaactggataccacctacaccttcaacggtgaaaaggaatggggtacggaaggccagcataaacacattgtaattccggatgatgcccctgcaggagattaccacatgcacttcaatgtatacgacaagaatggagaagtatcggaaaacccactggagggtgtccaattcaagaaaagcaatgtggaattgcagggggttgaaataggaaccggccgctcggctaccgcttctgacatcctgactaaattcactgtcaaggcgcaggatgatttgtattctatccgcctgcgtatttataaggaatctgctccgagtgaatatttctttaacagtacgctcgccgatgaattctccaaaggaggattgaaagaatatacattcaacaagaaactggaaaccaaagacgataaaggccggtatgcaacggcaggcgaatatattcttgaactccgtgtggaatatgcccaaggggcgaacaagattttcaaggaagaattcacccttgcagaaaagtagaatccgaaaatacataagtatcatgtcaagaaacaactattggttggcgtgcggcctgttctgcctcctccttgccgcttgcagcgaggaggacggggacgggaaagacctggacaagccgctcatcgaatccggcgacagcgcatcgccgctcaactgccaggtatatcggacaggagaagaaattcctttccggtatacttttacggataacgatgcattgggtagctacaacatcgagatacacaataatttcgaccaccacagccacagcaccgaagcaggagactgtccgttggacgaaaagaaactccccgtgcatccctgggtgtacaatcaggattttcccatacccggaaattccccgctatacgatgcccatgtgaatatccccattcctgcggacatcgacccgggtgactaccacttcatgataagagtgactgaccgctcgggctggcagcaattgaaagctgtcaacataaagatttcagataacaaataattaaataatgaagaatgatgaaacatttatcgctttataaagtatggaccctcatgagggtccttgcactgcaactggcctttgccagccttgcgtcagctgataaccagtctccgagagacacggatgccaacgtctatggacacgtaaaagacaaagctactgggtgaacatctcccttacatcaacctttgggtgaaaggcaccaccattggcaccaccaccgacgcaactgggcattatttcctgaagaacctccccgtgggtacacttaccatcgaagtgaaatacatcggctatctcacgctgcacaaagaaataaccgtgcagaagaactccacgcaggaagtgaacttcgagctggaggcggacaacatcgccctcgacgaagtggtagtctctgccaaccgcactgcgaccatgcggtggaagcccccagtcttgttaacgtgatggatacgaaactgttcgaatccacccacgccacctgcctagcacaagggctgagcttccagccgggtgtccgcgtggaggacaactgccagaactgtggcttcacccaggtgcgtatcaatggattggatgggcattattcgcagatattgatggactcgcgtcccatcttctcagcactgacaggtatgtacggcttggaacaaatcccggctaacatgatagaacgtgtagaggtggtacgcagaggtggatcggccctgttcggcgcatccgccatcgggggaaccatcaatatcattaccaaggaacccacccgtaactccgccgagcttgcccattcgctgatgtctattggtggaagctgttctttcgagaacaacacgacgttgaatgcctccttggtaacggaagacaacaaagcgggattctacgtctacggacagaaccgctatcgctcgggctacgataacgatggcgacggatataccgaactccccaacctgcgcaatcagaccatcggcgttcgctcctttctccgccttaatccttattccaagctgaccttgcagtatcatggtatcaatgagttccgacgtggaggaaatctcctaaaacttcccgctcacgaggctaatatcgccgaacaaatcgaacataacatcaacggcggtggcctgagctacgattatttctctcccgacgagaaaaaccacctcaatgtctacttctcctttcaaaacacggcaaggaaaagttactatggcggcaccggagaaggcattaccgaggaggataaggagaatgcggaaaaagcctacggcaccaccagtgaccttactctggtaggtggcgcactctttcggcaagctactcttcatgccgtctgacctcaccctcggtgccgaatacaactacgatggcctggaagatgaagtgataggttacgaaagatatatgaaacagaaagtgcgcatagctggcacctatctgcaaaacgaatggaagaacgaacggtggagcctcctcgttggagggcgcctggacaagcataacttggtagaccatgtcatcttttcgccccgagccaacttgcgtttcaatcctaaccgtagcatcaacctgcgtgccagctatgccggaggcttccgtgccccgcaagctttcgacgaagacttacacgtcagcctggtgggcggcgaacggttagtgacacgcctggcagacaatctgaaggaagagcgttcgaacagtttcagcgtttccgctgacctgtatcataccttcgggaatgtgcagacaaatcttttgatagaaggcttctatacggatttaaacgatgtcttctctacccgcaaactagcgcagccggatgctcaaggaaatgaggtgcaggaacgttacaacgcatacggtgccaaagtatacgggctaaacatcgaaggcaaggcggcctatgcctcctggctggagctgcaagccggagtgactttacagaaaagtcgctacgaccaatcggtggaatgggatgaggacgctccgaaagagaaaaagatgttgcgtacgcccgatttgtatggcttttcacggcaaccatccatccgctgaaacgtttgtctgcttctttttccggaacttatacaggcagtatgcttgtggggcgtgccggtatagaaaatggtctgggtatacgtgaaccggtggctctcaatactcccgaattcttcacgttaaacttgaaagtagcgtatgatattcctgtctataagtccatcaccctgcaggtgaatgctggggtgcaaaacctcacgaacgcttatcaagatgacttcgacaaaggctggaaccgcgattcagggtacatctacggaccgtcgcttccgagaagttatttcgtaggggctaaaatcagttattgatcagctacaatggttattatttaagcaaaatccttgataccaatagtgaagctgaaataaaagacccggaaattacttgtagtgagaattctaacaattataaatataatcttgaatactctgtaatatcatgatgaaaaaatgtttatgtttgattatatatactattgcctttttgtcctgtacaagtaaagacggggattgggagccaatggaatgggaggtagatacttcagcatatcttaaaaaggatcacatagcagttccggaaagtggaggaacttatacgttgttctgtaataattatgctactttttggttatcatctgtgtttgaggacggtgtgcaaattgaaacggacagtactgttggaagtgctgcaaaaggcatgtggagttctattgaaatacgcaaaaatgcaatgatagttgttatttctcccaatgacggcaatctaagtaggtgtctgtctgttactcctactgcgggggatgttttttcttcttttatctttaatcaaaaagaaaaagaaaattgatatcttactagtctttgccaaatagagtttggtttatacttttatctatatatccaaaacaaactaaatctgtttgcattgactgcatgataaatatgctggcgaaaagagaaaaaagacagtattcttcttttcgccagttttgcttttatggttagagggcttttgttacctttacacataaagcccaccacaaagcgatttcttcgttttttgttactattttgttacccactgttagtaacaggtggaattttagtttgataatcagagttatataatgttatttataataatgacagtatgaaatcaacggaatatattaaaatgggataaatacctcataataccatttttttattagtattagtcaacattacccgacataaaaatgaatgcgaaaatcctcctatccgcaattgttttttttcatgacccataacttcgtcactttaatcatacattctcaccgtttccactctctcacatagaaagtggaaaatatgaaggcaaatatagaaatttttcataaataatgtgtcataaataaaaaatataaacttgtcatccaacaatctcggctatttgattattgacgtcatcgagtacggaacgatccagatccttcagatagatacgggtcgtctcctccgacatatgccctaggcattctcctataatatggaccggaataccgtgctctttggctatagtggcccatgagtgccgtgcagcatgaagtcgtaatggagttgacaatccaagagagcaagagattttctttaaggcataacgaatcttgtgataggcatttttatatcctgcatacggttcttgctcttctgtaaataaaggaaagacatattctcccacggtattctcgtatttggtcagaatccgaatgatttgccggttcatcccaactcgcatcaactgcccggtcttatggcgtcggtaacaaatttcatccgggaaaagatctgctttcttcagcagtgcaatatcaacgaatgacattccacgagtataaaaactgaacatgaagatatcccgtgcaagagataccgtacttccctcctccagttccagtctggatacttttttgattacatccgtttccagacaccgtttgacggttttctctgttttaaagtgtacctcacgaaacggggaaggctgttccaaccccatctcctgacaacctttccgatagagagctttgatgttatgcagataaaaacagatagtattctcacatactcccgaagcgagcagttgtttgtgatacatggttatcacctggggtgagagtttgttgaatggaaaatccctgctgcctaaaaattttttcatcgaacttaggctggaattgtatgcgcgtgccgttccctcatgcccactttggcgaagctcccttattttatcggaaatataggaataaaagcctgtgccatgtgtcagtaagtcataagtcttgaatacatcctctatctcgtaaacacataatttcttttctgtcatagaaacagactttaacaatgttcttgagatcccctcacatttactattaattcttctgatgagttccgggtcgcttttcccatcgttaatgatgcgcccgatggtcgggtcgaacaggctttccgcaacgctgaagccctgtataaacaacttttttctttcttttgtgaagcacctgtacgaccaaggggaatctgccgtttcgagtacttcttccttttactaatactgttttaactgttgccataagtcttaaaatattaaatgttatctcctaaccttacctgctttcagcaagaaggctacaaacttatatacatcaatggaattaaactaggaaagtttattcatcctgtcgggatcattggaaagatgataagttacagtctgtaaaaggatctattgtcttctcctgaaaaagaagccagttctgggatgctagaggaagtggtggttaccgatatggttgctacaaacaaacggttatttactggtgcggcagataaactctccgcttcggatgtcaaaatcgatggtatggccgacataagcagggggctggagggacgttccgctggtgtgtccatccagaatatttcgggcgcctttggtgcagcacccaaaaaacgtgtgcatagcaggactgaatcccgacgacatagaaagcttccagattctgaaagacggatccgccacatccatttatagagctaaagccatggtcagagtatttgtgatcacgaccaagaaaggcaagcagggaaacagcagtttttcctacaccggtgaattcacaacccggttgaaacccaattaccagactttcaacatcatggactcctaggaccagatgggcatctatcagaaactttaggtaaaaggatggctgaattttgcatccatatacagggccagcaacagtggagcctatggaaagctgtaccagcttgccctcttctacaatcctgtgacagggtagttcgagcttctcaacactccggaataggttatgtatatctcaagtctattaaaacagacaatatctactatagttgagacaatgtatgaaaatacctgaccccatctgtgtttacctttcattattttcttatttttgcaccgctttaacgtgaatatgttaaagtcggattgcttttctttacattcggcaaactatatggcagtatatattatatacttttgggccttatgccttgaactggtgtggattgaaaaagcctgttgtcatacagactggtatggatggaagtctgttccaaggagccgggatattcgtccggaatgtatcaatttgtctgtaagcaaaaaagtatgtacatcagaattaaatatgcttgaacattattgtccactaaaaagcggacagttaaaaattaaataaacttggtttactaaaaccgcatcgttctttgtcattattgaaatgagttttgtcaaagaggtctctaagtttggttttatctgttagtgatatgctcagggtctgaagaatctcataagtggtttacaatttccatatcatgctgaataattgctacaaggcaataggcaatgactgcatagtatatttgtgttcttacggtattctctgtgttaccccagaatctctttattttcatatgttacttaagccatttaaagaaaagttcaatccgccacttgttttttataatgttctgcaatttgtagcggagataaatctatagcattggtaaggaatgtaaacttacgtttttgttcttcatcccaaaaacaaacctttcgtctgtgagtaggatagtccttggtacttttataaatactgagttcgccaattgcatcagagagtatatttctgggtaaacggcgtttccaatttatagctttgctatcatgaaccgaaactgtagtcatatggaaaaatgcaggtatttgagtttctatatcatatagtgtatgtattttaatacctccttttttcttacggaattttgcccaccaaaatacaaccaaacacaagtcaatgattgtagaatcgaaagcataaacattaccactgagattaaagatactagtttagagttttttttgtgcctgttacaaccatgtaataagcaagagattcaaaaatacggtagtctctattttgattcgctttggataaattgctcctggttacatttttcccaagatctaaatggtatgttttcccttgatgggcttccaatgcaataataaggttgcgtagacttcctctgtttgagagttgcccgaacatcaaagctagtagttgatttcagcatgtgaagtgcttcacgtatttgtctccaccatacttagcaacgatgcgattaaatttacttcggtcaaggaatgataccaactgtgagaaaacgtattgatcttgatgcatctgctatcatatttagtatgatgcaaatctacagtttcaaatccgttctctcggaagacctctataacaaattatatttcaagtatttcaaataactattgcgtttttttagtggaccctaatgatattttaattgcaatgaaacatatattttatcatctgaccgctgttatggtcgtcgtggtatggggaatgacttttatttccaccaaggttctaatagttcatggtctgtctccccaggagattttcctcttccgttttttgctggcttatgttgctgtgtgtcctatctcctcccatagtttttttgcccgtaatctgaaagatgagctatgcctggcgggtggcggagtattgggtggttccctgttcttctttttacagaacatggcactggggctgacacaggcgtcaaatgtttctttcatcatatgtacggccccgctattgacagctgttctgaccgtattgtccgttcggacggaaaaggtctcaagaggtttcatatacggatctattgtcgctctgttgggtgtgggcttgctgatattcaacggaagtttcattctccggatatcacctttgggtgatttactgactcttctggcttccctgtcatgggcgttttacagccttgtcattcggagtctcacccggaaatattctccggctttcatcaccagaaaaatatttttctatggcataataacaattctgcccactttcctttttctgccttcattgacaaagcctgctgtattgctggacagtgaagtgtggagcaatctcctttttttaggtgtcatagcttcgtctgcctgttatctgttgtggaatattgtcgtaaaacaactggggacgatacaggcatccaactatctttatctgaatcctcttgccacaacggttggggcgactatattcctacatgaggaggtgaccccagtcgcgataggcggaatcgtcttggttctctcgggtgtatatctggctaccagaaactcccgtcctcaaaacagtactgctataaaaaagcaagcggattgagttctgtttattttattattactataatcatatgcagaccacacttggtgataaatttgagattcaaacaatgtttttcgttttcttcccatcaagaaaacactcctttttacttattcctgaatgaaacaatagataatcatagatttgaatagattggctataatctgttaaattttaaataagaaactaaaatgtataatttatgtcgtaataaaccaaatatagtcccatttggaatatggagtaataatcacgatttccgaactttgcatataactattaaatagataacaaagattattccatggagatattaagattcttggtttctaaaagctgatagatcaaatgcagataggacctggttcttttggtttggaatagtctgacatagaagtttattataacaatattcattgcttttgtcgcagtgaaaataataaccaatattaatatgagaagtattacgacattcgaattgcaatatgcacatcggttctatggcttccagggtgaagcgcagtatctccatgggcacacaggcgtgttgaccattgaagtggaggacacaatcaacgagggcgtgaacatggtttacccctgcaacgagatccaaaaagtggcatgggaagtattaaaaaatttcgaccatgccttggtactccgcaaggatgacccgttattacctgtcatacttgacgtatatgagaaacaaggtattaaaaacggtcatccgcaaaacaagatgaaaggcgaagccttcaagacagaactggctacggcttatcccgaagcccgcttggtggtaaccaaagagaccatgaccgtggagggcatgattaaaatcgtgtatgacttgttaaaagacaagttgaacattgcgaaaatcacgttcaccagtggtgtgaatgctggatctgccgaattttcgaccaagcataacatagagcgttgtccgttatgtggtgtggcgctgaataatgaggaaggtgtatgtcctaaatgcggatacaggaaataaatcatatccggtaacacagtccaatgatgttggactgtgttgcttgtttttcttgctatattcatgaatataaaataaagacatggtgagattataaaatagagcaggatgtcatatagtaatagataatggatgtcagaaggttttatagttgtcaatattttgttatatctaaatcgaggaattttataaatttcttataatcaacgatattatgcagtcaaattttatttttttcatgaaagaaagaatcatctcgttttcatggcaacatttattgctcatcgtgtctttgttcataatggcatgtggagtagcactctgtgtacggtcaaactttggcagtagtgtgattgctaccatcccgtttgttatgacactcgcgggagaagctggcatggctcctcaatttacgattggagaatatacatacataatgaacattcttttcatcgggcttcaggttctcatcctccgccgaggtttcccacggatgcaattttttcaattcattattggctttgtattcggtttcctattagatgttaatatgtggcttacatcaatcatagtatgtaataccatattatggaaagtggcggtacaattaatggggtgcgtgctgcttgccgtaggcatctctttagagatacgatgcggctcagtcactatgccaggtgaggggattgtagtagcagttggcaaagctaccgatattccatttgccaaagctaaaatcatggttgatatctctctggttgttatagcagtagcttgggggtatttctactttggtacatggcaatggcaggtagttggtgcaggtactcttatatccatgattattgtaggaattatggtgaaattattcgacaagcatcttgaatggttcagtcgattactctactatcgtcccggattccgccgatatatttatggtctggcccggtgcatttgcgataagattcggtgatattttgatcggacgttaatattttagtagaaaacttatagttgtggccaaaagagttatttgacggcacagcattgcagactgccgaaagttgcacggttgctaattcgctatcgctgttacgcaaatattccccaaaatatttatttctcagaggcttgtattagactattgaaaatctaaaataacaatttaattataagcgtcttttcgaaaaacatagtagttctctgaatttattgaatttcaatttgtcgcaaacgttttgatggtgcgctgatttgaaattatctttgtgatcatactcaggcagttatgtataaagacaaatatgtttttacctgatcagtcaagtttcttggcagcgcacaagtacagacacattgtagataagtatgacggctacaggtatattgaaagttataccttttggaatcagccgcttataatgatatccttttttttaaaatgtcaaagagctaaatgattcgagtgggccgaacttatttaagttttaactctatccatttttagttgatagtaatgaattatgactatatgatactgcaaaatcacaccatacctgtaaatgagaacgacggtttaccgttatccaagcgttattgggctatcttagccactgccctaggagttggaatatctgtgatagacgttacaatcgccaatgtggctttaccgaccatcgcctgcgacctgggaacttcgccgtccgcaacgatctggatagtaaatgcttatcaaatagcgattaccatttctctcctctctttctcttcattgggagacatttacggttaccggaggatttacttatcaggcgttttgctattcagcatcacctcaggaatctgtacttgtgccgactcgttttggatgctgacagccgcccgtattttacaaggattcggagcggccgcaatcactagcgtgaatacggcgctactccagatcatctatcccaaacgttttcttggtcgcggaatgggcatcaatgcccttgtcattgccatatcgactgctgccggaccgacaatcgcttcgattattctctctttgggttcatggcattgtttttttgccatcaacatcccaataggaattgccgcactcgtaatcggactgatatacctgcctgacaatccggtaaaattaaccggacgccgtttcgacaagttcagttgtctgatgaatgcagtcacctttggtttacttatattctcattagagggtattacccataaagaaaacaccacgttgatcatagtcggggtatttgcgttgttgacaatcggttatttctttgtacgccgccagttacgccaacaatttcctttattaccagttgacctgatgcgtatccccattttctccatgtctatcggcacatccatctgttccttcaccggacaaatgctagccatgatctccctcccctttttcctccaaggaactctgggacatagcgatgtgacaaccggattactccttactccctggccgatagcgacaatgattatggctccgcttgccggacgattggtagaacgtatccacgccggaatactgggaggtatcggcatggtaatatttgctacaggacttttcctgctcgcagtactcccttccaaccctactaatgtggatattatatggcggctgttcatttgtggatccggtttcggattattccagacacccaacaacagtactatcatctcctccgctccatccaaccgtagtggaggagcgagcggtatgttgggcacagcccgtctactggggcaaacactgggagcgacacaagttgccatgatattctatttagttccaaccaacagttcgcaaacatgtctgtattcagcaactggttttgctgttgttgccgcaatagtcagttgcctgagaatttcacaaccacgtccattacaaggattcaaataaattgaatacttataggcataccctatatacaactctatactttatagggaaacgagcgacagaaaacaacaactgcaaccattagaaacaacagctgctgtcattaccgatatttttttatattgttgccataattattgaccaataacactttcctttcatctccatttccgagggaatgatatcctgctctttatcgaactcatccagaatccaatacatcgctttttcatcggcataataaatcatacgtcctttataattgaccgacttcttatgggaggacaaaatgatcgctgtatcgtcacacaactctgccgactcctgtttatatctcacacggttgtctttcttggaaatagtggcaactgtcccacgtttcacctccccgtcttttactttcaactaagcagagaaaaacaaccgtcctatttttccgcaccactgtgatatgtcccttaaatactgatttctgggtaaaaacacccatgttgattaccggtaacaggatgatttgaaatgaaatcagccgaaagtggagtgaactacacagtcatgctgctggtttccatcttggttgcctcttccggcggaaagagaaccttgaacttgacattgctgaatgttttcatactacggaaggtggtttgacagtcggtgctttcagagacgtagcaaggatcataagtagaggaaaaactgcgtaagtcgctttgtgcagttggttgtggagtacggagttgggaactgttaaaataaagtttatcatcacttatacgagtaatcccatcattatagacatagaaacaaccaaacatgttctttttataatacttcccatgccactttttggatctcgttgcaagggtaaaccatgttcacgccctcgttgattgtgtcctccacttcaatggtcaacacgcctgtgtgcccatggagatactgcgcttcaccctggaagccatagaaccgatgtgcatattgcaattcgaatgtcgtaatacttcttattgtctttactgtttaaagattatacattgtgtttatttaggataatttggacttgtcggtgaaagatattttgcatgagatccgtaggagagcgtttcgacaaatagctgttaccgggctttctgaatatagtgttaaaaaaatattatatttttcttctcgttagagataacagcaaccgcttcacaagttttttgtttctgacgccggcttacccgatactacgaaagacagcgcattgtctacctataaaatccagacaaacttgtatgtattgtatatccgtgtgacatatttatacaaaaagataaggaaataaaaaacaagtgtcttgatcctctaaaattttcttatcctttagcttttcatataattgttcaatagatttagtgcctacgctaggcatttggtataaagcatcaaatccgttatatttaatgaaccttaaaagatcttctaattggtagatattatatttcctgagtgcacgtaaaaccctgaagtttatatccagtttacttaaaggggtaattaatagatccacatattccgctggaatatcctgctctttccaaacaatctttacatatctgaaatttttttttggaacctcctcagaatgtgtcaaaagaaattcattattccggtatttgatatacatatggtctaactctcgttttaattctgaataaggtctccacttcaaatggatctgtcgaagcccccttttatacatggataccaggttcttggacgaaatgcctgttatctgtgaaacactttggagatccctacctgaagataaggaacaaaagacttcccgtgcttgtttgtcctcaatcaattctgccatctcctttacaatctccttgtaaaccggtaagcataccactggcaataactccatattatgtacatttgccttcttatcaaattctgttatttgaatgttttccgatttcttcatttcttaatccatttatctctatttttctttctcaactcgctgggggacattccgaacatcctttgacagtatgccgtgaaatgtgaagacgtactgaaatcaaaatatccggctatctctttaaaagagagctctgggttattaatcatttcctgtatatgtctcgcttttttcttctgtatccattgataggggctttccccaaaacaagaatgaaactttcggttaaaagatcgctctgatatatggtacaagtcggcaagttccttgaccgaatctgcttttctatagttatccaagacaaatctttcaaatgattccctgatattggttgatgcgggaaaaaaagccgccagttctttctttgtataaaaacctctcaagaccaggagcagttcctgctgctttagtaaatgcatatgcctacaaagcagccttgcgttcagatatagattgacggactccaatacattcatcaagggctttttgatcggaagtataacatcattcgtatcagtatcattttctttaattgataacgagcttaagaagagtttatcacatgtgcttatgtgtttatcccaaaacaagagaatacatctcgaacctgttatggattctatctgggcttttatactctgtggtatgtacaacatctgtccctgttccatctccccctcataaaattcccctaaatcgagatttacctgaccttgaatcataaagagcgcacaggacgacttgctgttgtcaatctggtatacatcatccttgtccagttggtggcaggagaatccggtatctgaattcatctgataattcgaacaacataaatgttctctcaaatataatagtttcactttcttctttcaaactgtttatatacccgtacaggcgctacctgcacgggtattttctattcaggtaaatattttttataatcatctgttatatccgggtcaatgaccggacgtacggagaaggtcatacaacgcctgtaaacagcgcttgtattggaggcggccgcccagccggcaggacctccagtggaattgagcagataacggcccgcatgagtttcgctcctggcctgtgccacggcgaaaatgacttcgttaccccctgtatagccgcttaagaaggagccgtcataaatacttccgggcagaggtgtctgtattccggatttgctctcgtaataatatgcgtatctcaaagtcacggcctctttttgtgacatgatccggaatccgtaaggagaagggtcaaatacggtttttccgcctacatcctccggattccctgtcagggaaggctggttccatggatacaggaacacccagcgatctttgaaattattaaccatcccatgcgggaaacattcatacagccagaaactttgatgagagacgatggcgcttggatgttcaatgctctgcttcatcgtaagagcggcccctctcgcttgctgagcatctgtttttccataatccacatcatttcccctttgttcccaaaggaaatcaaaagacttgccgttgccgtcatagaagttcgtattgacacgaacatcatgtgctgggaacgggtctttcctgccccattggtattgcataccaaattccctaaactcgtcagcgctatactgtgaatgaaccttctcgtaagcccccaacagatgcgacatcaattgaaccgtctccggtccgtctcctccatatttaccgacctccaataccgtcggatacttgtccactatccagatgtgccaggaccaaagtgtcggattccccttgatctttcctgacttaatctctatcagcacattccccggtttctgtccgggcttgacatagatatatgaacccggtccggaacctccctgctcggataattcactgagtcctgctcgctctatgtcattctgcccgtcgggcttttgaatgtccgtccacacgatattgactttccagtcatcatcttcatccagtttattcagcatgaagtctgatctgcttccgggaagcccttgcttaccactcaaaacagcgtcatgttccaaaagcttgttataatacctataggcggtattcacgcgggaaacggggataaatatcccttgctttgcacctgctttgagcatataagtattcgcttcaggctgcactattccggaaaccagttccacctcgaactctctctcaggaaaaagaccgtcaggggaataaattttgaatctcgcctttccggagtaaagacgtgaggttgtgatatcgtcaacagccgtgaaagaaactggttttccggaaagagaaggatccttctcatagaaaggagtgaacgtctctatcacatcacccgctccgttatcggacaaagcggaaaccagttcgatcttgtattcgctgttggccttgacataatattgcttctgtttgccgtccatcaggtagatactgttgctggacaccagcaatgactgatgcagccatttgtcgaagaaggggatggcattatattctttctgcaagaggctgagttttcccgatgcgcttctatcggttcccgcatgtgttatggtgaagacataagtagtattgaaattatcgaaatactccagattctccgtgatatcgggagctgtcaccgtgtatctccatatccctcccgcaagttgatccgctttttctattttgaacgggttggcggcttcggcatggaaaacgggttccaggtcatggggctctgtcttcacatagaaagtgaccttggcaccggcctcttccgccgtaagcgttcgtccgtctttcattatcaccttaccaggctgcccatagctctcgccgtactggttgacctcgataaactccagcggctggctgcacgcctcgtccgcgaagatccgtagggtgacattgatatccttggactgctcaaagccaaggaaccatttcatacggcccgctttcacataagcggctttcagcgcattctgggcatcttctgttttttccggccacgtgcggtccgtgtccacttgctccgtgaccgtaaaggtcacgattttctcgtcggtcggtgctgactttcctggttccgagggttttatggaatagctgatccatgcgggcagcccctctaccgtgaacccctcgggccaggaagtctgcactttcgccgtcaggctacccccctccctataaaaagtgaaatgatcatcgctgacccccagcatatattgcccgtcatactgcacgttggacatcgtggactcgttccataccacgacattgtacatgatattggcggccggccctttcctagcgtcctcttccgtatcgaatcccgggccacccacctccgtgatgttcaccaagtaacggtggttccgcagtaagggcaggtactcgtatgtcgcgtcggcctcggttcccgtacgtttcaaatagtctatccggaagaacgtctccttgtcgggacgactcttgtccacgccggtcagcccgacaacgatataggggcgtctcaagaaattttccgtatcctcttccgggagcgtctctccgttggctccttgcgtggcacccgtcggggtattgaccgcctccgggacatagacttcacgcaataatatcttctcttccgctatggaagatgtcctgtcggtccttcctgttacggccggagcgggatcgggaatggaaggttgtttcgcctttctattaacctgatcccaataagcctcgctctcgaacggagagatccgcccttttgtattggtgttataaaaaaataccttggtcagcgttatcccctcgataccctcggctttctcgtcaaacgtggaagccccttccgacgtttcgctcagtttaagccccacatctacacgtgccacggcacggatcaggtagatggtcccgagttttggaacggcgccggaaccgtgatccaccttgaccggatccgagactccccacatcgggagctctccgtccttccattcccccttgtcgggcatgaagaatgtgaaaagccccatgacctcttcccgtgtttttccggtcaactcatccgccccgatctcgtctgacgtagcgatattggccagcatcacgaaggtactggtattgcccgaaggggtatttttcgccagcagggtcatggtacccttgcttttcttatcatccggggcgctggagggagtgaaagaagtcactttggcctcgtatgagaacctattgtctttgtcaaacacaagtaccctgatcctctccgccgccgtctcgttctctccctccggcgtaagggagcgggtcagaggattccgaagcccaagcccttcgacggacatggtgacagatccccagccatccttggttgctatttccgttcctctgcctccatgctcatcaaaggggtcactgcacccttgcatgagaggcattcccataaatatcgccaagaaagcgaatagcaaagtgtaatgtttgattctcatatgtatctattttttaaactgtttctctttttgatggcatgagcgggtgcctttgttaccaggggatagccacttccgtatcctcccattcatccacaacaacgtcatgctccatgttcttggtccctttcagcgtggagaagacacggtagatggtattacgacgaatattgtaatacgccttgtcatcttgcccaagatccggattatagagttcgatcttgtacgtctcatcggggtctcccgtccggtaatcgatagatagtaccaaggccagcgcttcctctttcccgtagactcccggagccacatagatatagcgaggtgtctctcccgtatatgggagcaaccttccttgacatttagccacaaaggcggattctccggaaccctcgttggcaccttcgtgaaaactgggcctttccggtaacaacaggggatctcccgcgtagtccactcccctgatatccggattgccgctaccggtggcggtatattccccggcggaaggcagtacggaataaccgctggtctcattatttaaggagagtttcgtcactctggaaagcggtaacaaaagcgacaggtagtttcccgtatcatcaaccgtcgtaaggataaactcgacacgtgcgtgcgtgcgttccaggagtatactgggtgaaagggttaccctgccattgccgcccatattgtccggaacgtggagattgcgttggcctgccatgggaagatacttccggttttctcccttcagatcgtcggacgtgaaaatctcggttttctccgtcagcagtttcggatcaggaatcatatgctcttcccggatctttttcaatccggattcgcaattgaccaataagacaaaattataattaccacccatcagctccaggtccagggctatatcggagtcccctacgtttattcctcccatctctctcatctcgaaatgatcaatgccggttatacccgtcaatgggttggcagtgccttggggataatagaaaatgactttctccggagaggttccgatgttcttataagcgaagaggaggacatgcctgacggttttctcatatacctccgcgccgatataattctccttccattccccctctgaacgcacgggggccttcgtcatccgggaagaactcgtgcccttgttcatttccgccacgatccggatgggaatacccgtaacgaatcttttcatatcctccgtatcaggcgagcatccggtcaattgtacgattgccaggcaggtcactgtcaacaaccttatcacagttccgtatttcattatatatcgttttttataataatctcaactcctttcagataccacacgagtcttaaatctgtcctgagatgatatcagcacctagctctacgggacgggagacgacattccaatccaagacggtcgcctgtaccagcgtccatgtactcttctcatacttgagtttcagagttatgggaaaatcatggtcacactccaggctatacggtggttcgcccgaatcaccccggaacatgatgatgtcatccaccagattggcggtataaaagatttccccggttgtcttgttgaccagggatacgagcgtgtttctgccttcctccagcttcatcagcgtaaagtcagcctttaacaccccttccgtgtcacgtgtggcttcggccacgtactcaaaacgttcgcaaagggcgatctgcccgttaaagtcataaacaccgttgtcatcttctatccttatgacgaatttctcgtccatagggaatggatcggggatggacttgatggtaaaatgtacccggtatgtcagttcccgcatgttgaaggacacccgctcatatacgcttcccatatcctcccggttctccagcgatacggaagcgagcccgacatacagaggcgcagggactgaagagacccttctgtctttcaaccgtagcgcgccccacatctcctgcttggccgtgacgccttccttaaaacctgaaaaatcataggccaccaagtcgctgccaccccatgcgacaaacgtgagcttccccgtatgccgcaatgtggcgggcaaggaataatccgccgaaagaaccgccttcttgtcggagaattcacccaccagcacgtcttgctcgtcaaaggcaaatacccggacctgcctgatatctgacggataattggggaattgttcgcaagaagtccggctgtaaaattggaaattgacaccttgcggacaaccactcaagttatcgaatatggctgaatcgcaacctataaggcaacaggccagcaacatgataaatatggcaggatgtacgcttctgattctcatttgatatagcttataattgggattattaaccgtttgaggtctaactatttgtctattggagaaagaaggggaaagactcccccttccctctttgaaggttatgtaagaaatcgttggctgagtttacctcttatctgaatatcattcaagaacgacatcacgtgagacaaggttccactggagtaccttggccacgacacgcatgtaggtctcttctttctcgatatctggattttcgggattagttggttcagtagggtctggatcgggcttcggcaggtacggatccttagggtcggaagggtcccacggcatacccaggccctggaaagccgtaattgtcagcagataggtgttattacgacgaacatcagcgttcacaaccgtctttccatcagcggttgtttgacggttccacaacgcgcggtatgcgcatcttccgtttgtataggtataagcgttttgacccgggttcaactggcttttccgtgcggcttccttgctagcgtagataagcccatcaccttctcctcgatagaacgtctcgccctttaccccagatttactgattaacttaccttgatccgcgtcccaatcccatacctgttttggagtataagtagcgtagaccttggcataaggcaggcggtagtaaccataattcttgtttccggccgtgagagcctctttcttcactgaattctccaagaaataaatacctggtacctttttagcctcggctgcatttgccgcgaccgtcttggccgcgtacatgccaagatcagtcgtttgtgaaccttgtgccgtcaataggtttcccaggcggaccaaatgctccctggctgtaccattcggggcttgggcattttgaaaatcaacatagtcatcaatggcggatgtaaaatctttgtaaagcccgtcactctccgtgattgtacgctctcccgcatggttgcggaaaagatatgtctttgcggcgccgttgatagccgtatacgtgaggtcgtcaagatcaacggatcctcttccatccgttgtttccgtatttaaattatccccctttgcgaccatgccttgcgacacgacacgttccatgtcaaaggagaatacattctgggcctcttccgtgcctgtcttaactgtttccttggagatattgtcctggatggttttctgctcgacgctcgaggccatcacgaacttattttccgaggcgagagccgtgatgtcggccaccgcggtagccgtatttccatacacatagttcgtggccgttgcgataccgggctcaagatttcccctgttaaacaacaacgccattgcttgggagcccgcagtgactttccatggagcgaccgtgtaagtgccgttgactgtcgttgcccagaatttatcctcctcgtcagcctgtcctagcgtccagtctttagtcttgccgggagaaataaaccgtaaagtctcgagtttgctctccgcttctctacccgcataatctccttggctgtcatttaccgccttggtcatgacatctttcatggtagagatgtacattccagcgaatgtgcttccctcggcaggattccctaccggaggaacatcgtcatcattgcaggccgtcatgcctagacctaagaccgcaacacccgctaaaagaaatttgtttaccttcataacttaaaagtttagtgaataaataaattactattgttatataaagtcttaactttattcataagcgccttcgccatagaaaaccttggcacggtcatccccctgtttataagcctccttcagcaattcttccgcctttttccagtcccccttgatatggtaggcgaccgccatcgggaaaagggcacggctgtcgttcctcacgtcgctcaacacccgtaaggcgctgtctgcctttttcccgtattttagcaaggcgttggcatagttcagtttcgccaccacgtcttcgggaaactgttcgtacgccttttggaagacggggagggggctctccccccggatgagatatatttccgagagctggaacatctcgtgtgagctcagacactccggcctcgtggcaaatatttcaggtaactcctcctgggtataagcccttacgtcgaaactgaaacgaaaggtcgttcgacggagttgcggataaaactcattcaagaggatgtcataggtcctgccgttgtccaagttacgtatggcggattctcgttccgtatccgtcggataccggtctatgatagacagcaactcctctttattggacaggggagagatgcctacgagctttttaaggccctcccaatcctccccggcaccgaccgtccggtaagtcactgcccttttaagtccgggatatttcccggagatgtaattcgagagcgcaagggtacgcccttccgccagtgaccggttatattccgctttaccctcgggggaagcgaaaccttctatgaggacctctttcaactcggccccttttatatccaggcttcttgatatgaagatttccagccgggcgagctcctgcccgttattggcgaaggcttttctcagttcgtagctcgccacgggaaaagtgaccttgcagtcaaaggagtctttataatatttgaatgccaccttctctggctcgatgaaatcatacatataatcctctttcttgaaaataggcaggtcaataacagccacggttccttgattctcacgtatgccacaaccaacgcaacccaacagctcctctctcaccatcacatgtccatccgccatccagcgttcgaaagggacggattcctgcagggaaatgccctgctcctctatgtccgaaaaaggatggagcttattgtcgaaccgtgatgtccttgaattttcgccgagagccttcgaccgtgtaatggccttataccgcattctgcccgctacactgacaggcgcgaaatcaatcctgtcatcctcatcggcggaaaccagggatggatagatgacaagggcgtcctgtgactccaaccgggtcatggcatccacatgcagggaaagacgcaggctttttccgtctgcgcttcgcttgaccctcacgtcatacccccaatgtaatggtgacatgttccgcccaacgaccttttgggcctgcgtgaatatagccgtcaaaccaaggctggcacagacggttgacagctttatgtaataatgtatcgatctcattgacttcatgtttttatatcctacacctattttacccaaggcctgttttatttaagtatataaatgatagagagggcggctcttgtcgggccgaggtaatcggcccctcccttccccgtcctttgtccacaagccgtacatttgaactcgtcatatctcacgtgcgcgtaccctatccccaaagcggcttcaaggctgaacctgtcggataggatccaatgataaccggcgctgatgccgccaccgtagaaatagccctcataacggtgcgccttcatctctttatgcttgttctggagaataaaagggatgtttatcccaccgacattcatctggcctccatgcgcgtgcagcccgagaaaccaaccgttgaatctctcgcaagcccaatagcgtatctcgggttgcacaagccaatggctccatttccttgtcttgtatccatctgcggtgggatcgttctcatagaagaaaaaattcatgcccacctgggtatccaaggtccatttttcccctagagagaactccagcgagagattaggagttaacagcgcatcgtatacgagattattctttatcgcgaccctttgtgaaaaagactgcaagctgaataacaggaagaagaaaaaaatactttttttcattttggcactgatattatttttagcgaccgaaccgcttggttcataatgttaatttttgatgatgcaaagttataaaagctaaatgttacacttgttacataaaacagacaattagttatcgataaaagtcattttgaacgagttatgtccgtaatatcaacaataagacataattcttgatggtttctgccattccgctcgcggtaatagtgcaagtctcatcataccacaaatcctctcatcgtatttgtagcgtgtcgtattttttattccatgcacgcaatggtgacagcattagaacggacaaggtccttctgaaatatgatagtaccgacatcaagagagcgaggcacttcccgatgctacgagagaacgagtgcggaaaccggtatctttagaacgatctcccctttcggggccggagatctacctaaaagagaggccgtggacagcctagccatccattccatcgtgatgttcatcggctgtattcctccttgtccggaatccagctgtctatcaaatccctatgcccgtccatccactggcgtatggctctagtctcggtcccactggtttcttctatggcccgcatcagagagttgatctcggtatcagataggtggatgtttcccagaagggcggcagcgaacggatgctccttactgaatcctttcctagcgatggaatggatttgctcggcctccccataaacatttctcgagtcttccagcaccctcaggcgaaagcggtcaaacatccagtgcggggtccagccggtcacgacgatccattccttcttgtcgatggccttcttcagcaatgccgtcatggcgggaccgctggagatcatgagtctgtaatccaggccgtattcagggatggctttctccgtgcatttcatgatgccggtaccggcgtcaatccccacgatctccccggaaaaccgccgggtatgggcacccagttcctctatcgtatggatcgggacatattcaggtaccacaagcccgatacgagcgctgtcgtatatctgcccgaggatttccagcttaccatcgtatttccgaaaataatcggcatgggtcaccggcatccagctgtccatgaacacgtctgtcttgcctcttgccagagaggtgaatatgggggcgatgtctgcgttcaggagctcggtcctgtacccttgttccgaaaggatctccttggccagataggtgaccgctatcccttccgcccagttcgcgtaggcgatgcggattttcttgtcggatatgttaccgcacgagaagaatatcgtgatggccatcagggccgtgaaaagtatcgttctgtctctcataatcattttgctttttattatatgtgtcattccttttgttttttccgagccattccctgcgtgatccggtcaagcacgatcgccagtatcacgacggcaatccccccctcgaatcccatgcctatcttcatctgggtgatacctttcaataccacttcccccagacctccagctgagatcatggcggctaccaccaccatggagagcgacatcatgatggtctggttgacaccggcgagaatggtgggcaatgccaatggcagctccaccttgaacaggagctggacgggagtggcaccgaaagagcgggcggcttcctccacgttcttcggcacctgccggaggcccaatgcggtgagcctcgctaccggaggcagggcgaaaatgatcgtggcgaaggctcccggtaccgttcccaacccgaaaaatagcaccgccggtatcagatagacaaaggccggcatggtctgcatgcagtcaagcaccggctgcaagatcttgttgcagtgtccgctgcccgccatccagatccccagggggattcccagcatcagcgccatgccggtggaggagagtaccagggccagggtctgcatggtctcctcccagaatcccatcccgtaaacgagcgacagccccaggagggtgaagatccctgtccccctgccactcttgtataacgccaggaaagtgagtatcgcgatggttatgtaaaaaggtatcccgagcaggacgcacagtatcccgtcgataacactttccacccctaagctcagcaggtcaaaaaacgatgcgccgtgctcggtcagccattccacggccatttctatatattctcctatatttatcataattctattgcgttttgaatgatttcattgatttcttccttgtcttttcccgtcacctcgataatgagcgacgagagcggtaccattccctcgaactcccgtttctcgttgaccacccagatgggcgagttggtcttcgtcatcagggggagtatgtcctccaccacagtatcgcccaatatggagtgtacctctttccttacgatagagtcgatgttcaggatacgctccttccttaattggataagttccttcagatggacctcgcctaccagtatgccatccggatccactacgggcaacacggttattttacgttctctcatcttcctgatcaggacctccggtccctcttttccctgccttgccaccataggcttgtccaccatgatggatgcggcggtgataatcctgctgcggtccacgttctccacgaaacacctcacgtacttattggcgggatcggtcaggatctcctcggaggtaccgatttgctgtatctccccgtcacgcatgatggcgatacggtcaccgagcttgacagcctcctccaggtcatgcgtgataaatacgatggtctttttcaccttcgactgcaaggccagcagctcgtcctgcatctgtacccgtatcagcgggtccaaggcggagaaggcctcgtccatcagcaggacttccggatcattcgctaaggcacgtgccagtcccacccgttgctgcatgcctccggacagctcgttgaccatcaggtcggcgtatccgtccagcccgaccagacgcatgctttccgccgccttttgctcgcgttccctcttttcctggccttgaagctcgagtccgaaagcgatgttctgcaatacggtatagtggggcatcagcccgaaatgctggaaaaccatcgccagctccttccggcgcagggaacgcaaccgttcatccggaactccggcgatatcctccccgttaatcagtatctcaccggaagtgggcctgttcaagcggttgatacacctgagcaggcttgacttgccgcttcccgaaagtcccatgatcacgaatatctcaccttcccggacagagaggctcgcgttgttcacggcaaccgtacatccggtctccttcaggagctcacttttacttttcccttttttcagcatcttgaaagccttgttcctttcagagccgaaaatcaaatacaaatccttgatctcaattttatttttatccataatcctttaaaaataatatcctatgtttatattaaacctgacattccagttgtcttccgttccaccggcaaaggcttcgtcccatacgtcgccaagccatgcgtgattcctccccacggcatagtcgatgtaggtgaagacctttcctatcgccaaagaacaccccgtcacgttctccaggctgtcattaaacccggcgacgcgtttgcccagcaggctgaaatcattgtacaggcagatatcgtccagaaaccacttgttcacggggatccggtaggacaatgacaccgtatatatatccgccctggaggcgatccggtaagacgacccgtaagccgccatcgtcaccacacttctgtcttcccctggagcccgcacgggtctgagattatagttggtatactgcattttaaggttccaccgccgatagtcggcaacatagtgcagggcaaaagcggtacggagtcctgtctttcgtgtgtccatattatacaaacctcccataaggaccgaacctccgagttgatgtctccacaagtttccgaaatgatataccacccggatattgccctgatgcgcctccttatcgcgtccggcgatgtcataggcatagcggctggcggacagttccgagtctcctccggtcccggaaaggtcggcgttctggaaataggcgagcgacaactcccagcggtccttatggaagaggtattttatccccatgtccgcatcgtcctcaagaccggcataatagttcaggttgaagaaataattgttacccgtataaggcaggacaccgaaagggaccgttgtcaggcctatctgtaaccggtgtgaatcattgaaacgatagcctatccaaccttccctgagcatgccgcctcccgaggaagagggatagaagcggtaatccaccgctaaatcgatttttttataggaagcgttcacgttcagacggagcacgtcgaagtcgaattctccgccacgattccggctttccggtttccagtctgagtaattgtagttgaaccggagtgcgcctcctatttttaacctcggtttttcctgcgctgtcacaggcaaaatgatatttatcgccaaaaggaatggcaatagcaaactttctttatatcgcataaagtcacgttttggcaaggcatttatccaatacctcgcaatggtttataaaatgattttcttaaagcaggccctgcgtaatttctaagagaggatgaaaagttatccaatgcgtaaaatagaactaaatgtacttaaaaagtagttggttttcgcctgcgaatttttgcaaagttaagaaaagcaaatgaatataccaaatttaacccaagagaacccttgaaaatgtgggaccgagcttttaaaaatgcaagaaaaccggcagcccccgttctttccactaaccctgtaatgttttcgacattatctcgctacagaaaacatatattttaatattgacacgtaagacatagtctataaaccaaacctcttgattcatactaaacatggcggaaagtatctgactcttctcagattcatttgataaacgttccgttcctcaattcttcgaaagattctcgcagctcctcgtgggtattcatgacgatgggacctccccaggcgaccggttccctcaaaggactggcggcgagcaggagaaaacgtgcgccttccgctccggccttcacaaccacgggctcatgtgtcctttctccaggagcggaaacggaatataatatggcgcaccccttatcctcgatcgaccgttgttccggatcggggataagcgagccttccagtaaatagataaatagtgtctcattattgtgggcctcctcgtagctccataaaatgccggcaggcaaggttatgtccagatatgtaacccgggcgtgcgaaccgttcagagccccccgtatcccctgatagcaaccggataggatacggacggtcgctttatcggccaccaccgggatatcggttaacgagatatctctatatgtaggtggcaccatctttttcgtagcgggcaggtttacccacaactggcacccgagcagcctttccgaaggctgcggcatctccttgtggagtatcccggatccggcggtcatccactgacagcccatagagcggatcacccccttgtttcccaggctgtcctcatgcgccattgttccgctgactaaataggttacggtctctattccacgatgaggatgccagggaaatccctttatataatcctgaggattggtggagtcaaaaccgtcaagcatcaagaacggatcgaaatcctgtatcgtccgatcccccaatatacggcgcagacgcacacccgccccgtcaactgcgttccgtccccttacaattcgggtcacttttctttgtctcatattgctgtcatttcaatattaattatcctttctctattcatgtgtgaattcacagtccacaataatccgtatatcgtctgcaatcatggccggaacaaacttaagaccgagatcaaactctgagcgtttgattttgccgctaagacgaacgcctactgtgtctttttagatacgggactcttcctcttccctatcagtagtacttccagctctatcctttgggtaaccccgtgaagtgtaaggtctccatatatttttcctttcctggtcttctccatctttatctttgtacttttaaatgtcattaggggaaagacctccacattaaaaaaatctggagaacgcagatggttgtcccgtgccaccacgcccgtacttatactcgtggtctgcacttccgccaggatatgcgtattcttataatcgtcatttgcctgccttacagagatgtcaaaatccgagaaatatccgctgacaaaggagagccccgcatgtttcacctcaaaaccgatacgagtatgatcgggatcatccttccatatggcagccagtgcactgaggttggtagttatcataaataaataataacaagatgaaaattagtgctatcataaatcaaataacatttttgaaaggcgtatattattccatctggtttcaggagaataaacccgccttcgtttttatagtccttccgaccatatcattccttaagggtctcaacgaagaaagaaccattatccaacaatccctggacaaacacaggaacagtctccttacgctcccagtccctttgcagttcacaaatatattgcgtaacggaagtcagacggactccggcctgctccatccgcctaagggcaatctcatgggctacttcggatgtgccaccaacagcatcaacaatggtatatacctcatatccctctttcaacaagtccaaagcgggaaaagaaagacacgcctctgtccatagcgcacaaatcactaatttttttctccctagtgccttgaccgcttcttgaaaatctttgtcctcccatgaattgattgaggtcctatcgatctcaggctggtccggaaggacctttttgatctggggaatggtaggcgtattaagaccagtggcgacatttaccgtagttaagacaatcgggacgttgaaacctttagcaatccggcatacattagatatattttccaccaatttctgtctgtccatagaagtaatggaatgaacctgtattggttgataatcaattactaacaacgctgaattttcaggtgtcaacaaatgatccgtcttaggatctctaataggcttaatactgctcattgtataatgttttatagtcgttaaataattattgacatgatgatatcctctgtttttcagaatctatttactacgacaaagttcgtgaattttctccgttacgatgtgttcctaatagagcggtatttagtccatcacgatacaccttgccggagatgtgaagatgattatcccatttgcatatttgattttttttttgtattttgcgttcgcatttttagatggacgctgattttgtttatcggacattctaatttgagagactgaccattctaagaaattttatcatttaattatgtgattttttgacaacatggatcataccaaagatacactattggagttgatacggggaacgttatcgacaaccatatataatcaaggagtctatatccttaatatagaagaaattcttgataactataaacgtaggatgttccatgccggttttttctattatatgctggtagagagtggaacggccaaattcatgataaattgccattcccttaccttaaaaaaaggtgatatgcttctcgttactcccaggatgtctgtttcattgaaatccaagagcatggaatttaactcctatggtatatgtatagaaccttccttttttgactcattagcagtaggaagttatgcgtataaaagcctctataacgctggttctatgacgttggctttacagttggataatgatgattttgcatatgtgcataaaacattagagctactggctcatagcctcacttttaattatcctgttgaaatgatgagtcatttggtcaatttcctattattacaaataacaaaaattgttgacaatcaaagtgcgcgttcctctggaaagatcagccgtcctgacgaactgttccgcttgttcagaaaattattggccgaacattaccgacatgaacataccattgctttttatgcggacaggcttcatgtgtcccgtccttatctttcaaggattatacgtcaggtttctggaaagacagtaaatatctatataatggaggcccttctctctgaagctaaacgtttgttgacgtttacagatttggcaataaaaggtattgcggaaagtttggggtttgcggatcaatcgtctttcggaaagttttttaagaaaggaaccggaatgtcacccctaaattttcgtaacaaaaatcaaacctctatagaataaacacttatctgttcctgaacacctgtatattctctcttatctagcttcttcctgccattgttttttagggtacgaggccggttattcacgagaaggcagtttacgggcttaattttcccgtcaagccaaatgctagctgttttcttctaaccaaaggcagaaacaaccgttccataagcctttcttgttttcaacgggtactttgtttctgcctttggctatgatttcagcggctaaatcgcttttacgcccgacaacgtgtttttgtggctttccgttgatgatggcctcgatacgaaagtcatgccgggtgtcctcgataacgttgatttctgatacctgaaaactgtctttgtttcgtatggctcgatgacggtgggcaagcagtgtttcatggcttctcctatggtcggagatactaaggtgaaaagatgtcaatcccccctctaacactcacaacattatttcccatgtcttatccttttcggtttttttattcatcatttattccattgtatatgctgaaacaggtaccggcagtaggccgtccatctgttccaagcagttcactacccgtaataggaaaagaaagttccccatatcgatattgtagacctttccattctcaaacaggcgcaaggtgataaggctgacaccggctttctcggcagcctcttgccgggtgggcccataggctagtctatattccttaaatcgtttgactaaatccgctatgatttctgggttagccatggcttgggtgacgtgattcgttgtctcgctgcaagggtaaatatattaactgctaaatcaaaatatgataggttacaactaatatatttactattatattgaattgtgcgagatgtctttgtgtactaacctcccaattccatgcttcgcttattcccgtctataattgggctttgagcaggctttatgtcctgaatactttttagcattctttccatttggaatattttggcggcagcgataaaggtggtggatgatatatccggctggaggcttttcagtacgttatccgatggctgatatcctttcatcttcaactccagaatggtgttgaagtcatcatctcgcatagcctttatgaaggtctgttcttgttcgttgacaatattcggcatttggatcgtatgcggttgcttaccgaacaagagcagattttttccgataaaatcagcgtgttccggtttgaccccgcaatccttggctgtttcaagctagtgcgatacggtttcctgtaccttttcgataatctgtttgtgttcccggatacccatgttctctcccactttttgcagatcttccatcgtgaaattgtcttgtttgccattgagtgacagttggtgacggttcgtccatttgccgcccggtgtgtatgagtagcagaggtcgtatgcaggagacagtttccacttcccttgtttatccatcaggaaagagaagttcttgctatggtcgtcatggttccggctcatgacgttgaacaccatacgccggtatagttcttcttgttgcggatagggcaggttcatctgccgcatgaaacggaagatctcttcgtatgaacggcgttagtcacggtcatagtgggcaatcccggctaatgtttgtacatggatcttctctccgttttccacacggtcgaaacgacgtgtcatgaagtggcatgactctttttcctgaagtaaccggcattccatcatatcgataccgcaggcttttgccatccggtgataggcatattcgatgttacctattcctcgtggattgtccgttatctgcgtgtgttcgctgtatttgccaccatcaaatttcaatagccagtacccgaagccttcgggggcttttacctgtccggagcgtacttctccggtgatatcgttataggcgatgattgctttgggcttggcacctccggcggatgtccccactttcagtatgtccagtatgtttcttccttcctgacgcagttgggcctgaaatgctttcctgtccgtgaatatggatttggcaagctccgtcagttcctcgatatggaggaccgatgactcgttcatgccgttgatcggtgagtacggctcaaactccagtgcgcccataccacgtttacctacatagcaaagcctgtctaaaggggtgatctcttctccggacaatccccggctggcgaaccactcgttgatgatctggtttccgaaagtatccggcagtgaatcggcgaacaatccgggcaaccctttgaaacagtccgtacggttttcaaggaactggtagggcgtgtttctgtactgggcaatgggcataatgataggagaaatgtcaagaccagagcggatgaacttccgttcatagtcgaacaaggcagaattgctttccttttcccaatagagagaacctacgctttctccccacagcttcacgtctactattaaatcattcatggctatcttgttttaaatggcgtacacggtaacgttttttcccttgcagttttttgagttctatcgggctgatccggatttccggtaccagttgttccaggttctccaaaaggccgagtgaacgaagtacactgatgaacaacagcagcgataccgatttgcctttctcgatgttcgcaacggtcaaggggcttacaccggaagccgttgccagttcttcctgcgtgatgtgctgcctgatacgtgtctctttgatgcgttggccgattttcaccaatacagccgggttgctcatttcattccacatggttgttccttttttgtaaatatacaaataatctatataaatagatggattaatcttgaatattagagttaatctatataaataaaatgattatggttgtctagatttatctgttattcttttttgaacatagatggatttaataaaatcacaacacattgtgattttatttgtttttcatgttttaaattggtatttttgtcgaaaaatcacaatatactgtgaatatgaaagagataggaaagattatcagggaacgcaggaagagtttgagggttaatcagctggagttatccgaactggcaggcgtgggtatcaatacgctggtggccatcgagcgtggagaaggtaaccctaaattgaaaacattgctttccatacttgacacgcttgggcttcaaatgactatcgaattgaaaagttgaatttaacggttaattgaaatgagacaatgtgaggtttatttgcacggcattaaagccggaatgttgacagaagaggataatggagaatatacatttatctatgattcttcttatttggagaaaggggattgtccatcggtcagcttgactcttccattgcgtgaagaaccgtatcggtcaacggtcttgttcccgttcttctttaatatgttgtcggaaggtgaaaaccggaaattgcaatctcagttattgcacgtcgatgccgaagatgactttggcatactgctggccaccgcccactatgataccataggtgccgtaaccattaaacctgtattgccatgatcaccttgacggtttgtccttcaacactggcggaagggttcgatactcattctcctgccgcacgtaaaaaaatgtttgacgataaaatggtatctcattatttgagagtgccaagcccttcgaccaacagtaaagaagccaatgaagctatacgaaacgcgaagcgaatctcactgtcgggcgtacagcccaagtattcggtaattgttgatgaacaggaatcgtatcttcgttatacacaggaaggcgagcagggaacatatatattgaagccgtgtcccagcagttaccatatactgaaccgggattattgcgctgccaatgagcatttgaccatgcaaatagcggcacaggtatatggaatagaaacggcggccaacgggctttgctttttcaataatgatgaagccgcttatttgacacggcggtttgatgttcatgacgggaaaaaatctcagcaagaggattttgcggcactgatgggatatacgaaagcgaatggcggaagtgattataaatattgcaatggcagttatgaagagtgtgcggaggtaatacagaaatatgtaaaagctgcccggattgatatacttcgtttcttcaggttgattgtatttaatttcatctctttgaatgacgatgcgcatctgaaaaatttctcgctgattaatagtggagatgaatatcggctttctcccgcatataacctgataaacacctcattgcatttgactgaacccaggagattcgctcttgataaaggattgttcaaagaggggatgaatttgggggatacccatcgggtaggtcggaaggatttcgaggaatttgggcggcgcatagggttgggcgataaattgataaagcgtgaaattgatgggtttattcatgagaaaccgttggtgcaggcattgatagatcggtctttcctatcagaagaactgaaaaagcaatacaggttgtctatgagctacaggtgtaagatgctttctttgcaataaaaagtggtaaggcttatcggtaaattatatctttgtttttcatattgttcgtatctttaaagtaaagtgataatgatgatgtgtatgtgccccggtatgtctatcattgtggcaatgaaagcagagagaggattgatttttaagtattgtcatggcaaaagaactgatcgtgttcccaggattcttggggaaaattataattccgacctgatagaacggttgtatgaggcaggtggcaatgtcatgctggatcttatcatatacctgagcagccatcacctgaaagacctgttcggtacctcttggttctctgtggaggatttttgccacaagatgggttataaccgtaccaacttacagcggaaactgaccgaagagcagttgacagctatgttcggaagcaggacacccccgaaatatgtagttgccggtacggcagggaaatcggtcactcacccgatagagacggtatttgaggcggcgatctataaattgggattggagaacttgtattatccggtagccggtgaagatggccgtacatcttataacttcgtgcagatcttgaaacgatttgatattgtttccgacttcgagacaaagaaatcgacgaaaaggctgtattcggcggtgataagcccggagattaaagacttcatgttttcgctctataacctcttggaacttcaggattatcgaaacttacccagccgttatcgttatttttacttggagctatccaagatgatttacctgatcaagtatagagtcaagaataacgaaactcctttctatgtgctgacagtcgatcagctggctaagaggttggggatagaaatagctgaacccaaatatcggaaaaagaaaatcgcctcgatacttacgaagatgaacggctacctgaaatataccaatttcaacttttccttcatcaaaggtgagcatgatagatgggcttataccgttttgttctcgtttccccaagatacgttgcgttatttcgatgaaggacagtatgcggtcgtgacgaagcgattttataagagcctgcttaagttatatgtggagctggtttatcctgagatagagttggaatccagaggaaaggaagtgaaagaacaggagaatgataaggaactgtatggcgagttccttcagtgggccaatttctctgaaaatatcgagaagaaaaagcaattatatataaatgattttgtggctgttttcggcaggtttcccgaagggtggacaccagagaggcagcaggaagttcctgatccggaaaaattcatttcttcaaagagtggtgctgatagaaagtccccaactgtgtaaaatcgttcacttttcacgttttttttgctgttttagttgtgtacagatgtcccgttctttacttccagctgtatgcgaccgtccctctttcctgctccaattgtgtacaaccgtccgtaatatagtgatagctgtgtgaaagtatccactcttttcaagaaaggagtgataggggggtaagtcagtacatgattgttatatagtcgaataaagaaacggaatcttctaaaaaagcctgatagctgtgtaaaatgatccaccatattacataagtatacctaaaaccctaaccctttatattccccgaaaaactacatacaaagaaatgaccgggaaaatgaattttcccttcacacgctccatacttactttcggaaaaatattttccggaagtagatgttgaattttacggtttttaatatgcctgaaagggtgtcttgctcttttacgctaaacttatttctagggcgttccctttcgggcgggctatccgttgcaagtcctcgttaccctccgggcttttccctgctatccttaacgctttatgctccggctgtgccggaagagaggtatgatgattttttcctgaactgataggaacattgcgaaggtaggcgggggcggaacgtccgatattgaaaagccaaatctccagccttccctttgggaaggtagtatttaccagttcaatcccgtcctaatatccgtctttcccgctttctcttcaaagcactgttcccaatcagttgaggaaaaatttatggttggggcgacaagcgatgtttgcgagtattaatcttttaatttttggcagtatgaaaacgaagagaaccgtatttgaggtgaatgacgtttatcgggtgatggaaaacagcgagttgatctatgtcttgacgaacagtgagaaactgaaacatgaggaatataagtatgaacagatggaaatggacgggttgtttttgtctgatgtactggaaacattgacacccagccgtaaaaaagtcgcttatgcggcgattgagctgtataaacggctgaaagaaggacaagtcgaaaatcccgcggttttgtccagcggtaatgtttgtaaaatgatgcatcccgttttgtgcgatatcactactgaagagatgtgggtgctgttgttgaacagctcgtccaaactcatccgtaaagtccgtatctcatgcggtgagataaataccgcccctgtggatatacgggttatcatgaagcaggcattgtattataacgccgtatcttttatcatggtgcataaccacccgtcaggagcacgcaagcctagcagtgcggatgaccgcttgacggaagcggttaaaaaagccgctgaaacattagacatccgtctgttagatcatgtgattgttgccggtaatatatattatagctatgcggacgagggaagattgcaaaaaaggtaaagatggacgggaggaatcccgtctgcctgaatttcagcttcggggttcttttttggcagtcatccccaaaaaagagccccaaaaatgcttttctgactatcggatacgatatcgtaaaatacgcaaagacgtagcttttcagaataaatacatatcttcacgttaaaggtaatcggaatgaatatattttctgcttttgatacaagcgttatggtggctctcttactgggtattgagtttcttaggagtgatatccgaacgattctctattgtaaaaggaatgatccctggattcttaagagttgcttatatacgctgcttatattattgacaagcctttattctatcgtggtcggtgccatgcttcatccggaacccgtacctgtttatgaattgatgcccggttttcaaataggggtttatggcttttccttctcgtttatattacttgctatagcatgtctttatcgtaaaatattaccttttgtccttgggggatacgctataatatatgtaataggtgtactggtaccgttacttagatttgtagtggctatgatggattatttcgctcgagcaagggtgtagctggttaatttattgattgtatcggatcgccctttctgtgggttgcctcccccctattcttttcctccgatccaggtccggctttttgcccggcaaaggttccagtattccgcaaatggcaagttacagccaagtgtctttactgtatgaaaaataacgatgaagaagtgtcgccgtatacaggctacaccgattgttaacgcataaaacgcaaaagtaagcgaatgacttaattaatatttcggtgaaaaattaccaaagtattgtacacattaatcaaagtttaaataaagtcgtgttaccggagataaggaatatgaaaggatatttgaatttcgatatgatcggttgtaacaataatgaggaagcctacccatatggtttatctcttcatgaaagtgtaccctgctttcagtggttggcagaagaacgatatcaagagatacgacttgaatctgacaatggattatcgtccatgggataattcagcgtgagacgatagcgaatcgttcgccaaggtgggtattcctatcacctggcatcataccgatcctcgtccctactacaacttaccggacgatcatgcggatcggatcaattgggataagggagtcgatattatcacgaaagcttctttctcgagtatgtgggcctgtgactaacgataaggagttttagacagttaaatataaagagaggatgccgctatcctctctttatatttaacattgtcttgagtgcattaaaggatcggaccagctccccattgcggcgcattggtgtcctgccaaatacgctcgctattcaatatgtcgccggagccaacgcttaagccctgttctttataagcctcgatcaagttatcatacatcaagtctgttggattcggtgcgttcaatgctacacgacgcgggatattggtcacgggataaccattagcgctataatccatacgtgggaaaattgaagatcctatcttaggcacgccggaacgacgggcggtcgagtaagcgtctatcggagacatcaagaaatgtaagatttgttggatatataccttttccaaatcagaagccttgtttcctgtcaactgatagtctttataagacatcatctcatcgatctcgcctgctaccaaatcaataggtttctcgtttggatcatagttgtaagtcgtaccgtaatacgggatcttattcgagcgagccaaacggtcgtattcctcaacagaagcgcgaagcgctttattgaaataatcttgggccgatccgggcaggttcgctcccaataacttgaactcagccagatacaggttcacctcggctgttgtcatatacataccataccaaggattgtcttcgatgtcttggatcacaggatctcctgccgcaaccggataagtaaagtctattcgaccgtaaacttgctcttgttggaagcgagagaatggttcatagatataatcatcattgtatttacaattaatattataattgaaccaatccccaaatttaccagcttgttgtccggcattgtaatccaatgggaatccttggtaacgtacccatggttctccggctcctttccaagcgttgaatttatatttaccgtcagctcttactgaataatcgatgctctccatgatatagtgaggaatttgtgcctgcttgccagcatcgaagaataactgtacgacattggaattccattcatttttttgaaaaacgaaacggacacgcgggtcacggttgttaaccatgaagtcgatcagcgtcttcgagcctcccacactttgcaaaatgccattgttccagtggtaggtcttatcttggttggatgaattgtaagtaaccttgttgaacaagaaatcatcatccgtgccattcaacacgccacaggaggcattagctacttgttcggcgatttggatcgctttctgacggttttgagagatcaaacgagccgcaatcttcaatttcaaggaattcgccagtttcgcccatttctctttctgaccgttgtaaatagcgtcttgcgctccctcgaacacttgattttgggctgtcgtgaaagtcgtgatcgcttcgtccatattgttcagccacagctcatacaagcgttccacgctgtcatatttcggtgtcaaagttccaccatgcaacgcttgtgcagcctccgtgtgagaaatatttccgatgaaatcggagtcgaagattcccatataagcgcacaagacattaatggcagcttcgtaggcttcatattgggcgctttcctcttccgacatttgagagcgaacgtacttgatctcattggcatatttcaatacatcgattgatttgaatccgggattcataccaccgtcaaatacggtagaggtcacgccccctgtgctgaccaacaactgtgtccattgatacatctggtctgcattataaaaccaataggtataatcggatggttcaaaatccaaaaccccttgggcaaacaaatagccgatatcgccttttgtcaccgtcgagggatcttgtttcaattcggagaaatcatcttgacaaccactcatcaacaaagatgatccagctaataacaaagatgttatatagtgatattttttcatattcttattctttaattttatgcgttaatcaatgaatttagaaacctacatttaccgtgaacgtgaaactggaggtaacacccgtcagagaacggatacggaactcggcggcagctgtaccggaaacggactccggattgatgttgtttggcaatgagttcaataagtaacccaagttgtgcccattcaacgtcaatacgcaatgtttagccttgattttctcgcaagcggtactaggcaggcggtaacttaaagaaatgtcgcacaatgcgatatagttcaagtcttccacccatgagttatttaccacaccataatcgcgaccggccatagtccaagcgttgttgcgatatgtccatgccgaagcgtgtgtcggttcgatcacgcccttatcgaacaattcttgataagactgtccggcagaagatactccacccgctccaacagtatagatcgaaccatcgggttgcgtgatttgcgtgccttgcgggatgataccttgtgggatgataccgtcgttataagtctttccatcgaatttggatgtccaagtgacaccgccatgtcccggtgtccctttcaaggattcttccatgaagccataggccgtaccgtagcgggagttataggaagctacttttcctccaaaacgcatatccaatgagatattcaaactccagttcttatatttcaatccggtagatattgatccaaggaaatcaggaatcatggaaccgatctcaacgatcttcgcttcgtttcgcaggtaatgagaacggcgtgtcccgtctgtccaaaccaacatgggcaaaccggatgacttatcgaatttataatagctatctgtcatcagggttccatatgaggcccctaccttagccacggaaccgatacggtagttcccataggcgacatcaccggccagtgtaatataatccgccacattctcgtgcaattccacgattttgttcatgttctttgtccaagtaaagtccaatgtccactcccagtcttgattctggaacgggatcgtgttcaaggccaactccacgcctttattttggatgttaccggcgttgatcaattgcttggtgataccagatacggccggaaccgagatttccatgatctggtctttcgtgttctctttataataggtagcgtccaaaccgatccggttgtttaggaagcgccaatccaagccaatttcccaagcgttcttacgctctggcttcaaatcttggtcgtacatggttcccggcaatgacatgccataatagtttgtcccgtttaacgtggatgtgttgatttggtatgccgtgttgatgatgtaaggacttgtatcgttaccaacttgcgcccatgaaccgcgaatcttagcgaaagaaatccattccggtaactgatcgcgatacgtgcttgagatcaaccacgatccgtttacggatgggtagaaataggaatatgatccgtgtccatcggcgtaaaccaaggtagaagaccagtcgttacgtccggttacgtccaagaagatttggtctttccagttaacgccggcttggaaagctacggacaacatcttcttgcggtcttctacctttgcgccataagtgggtgtttgctttgagttttcgataaaatattggttgggagcgatcaggccaccattcgtgttcatcgactgtgcctgctggaagttctcgtagaattcaccatgtaagaaaccattcaccgtaaagtcgccaaaagtcttgttaaacataaagttggcattcaagttagtttgttccttagtggtctgtccgataccatagtaacctccttcattggcgtaaccggagccgggttgcttgttctcaaagcgggtatagtagtagttgtagctacctttcacgttaaacttcaaccaatccaataggtcgatatttaatttcacgacaggacggactgagatctctttttgtcggtaatcgttctcatagacgctccaccaagtaccgattcccggcatattaccatactcatcgccatagcttgagctggccaaacctccgtgtacgcctttatatttgtcctttgcagttgatggatcatatgaacgtccccacacgccgcttgcgaagttctctccaatgttgatcggagagttctttggcatagagttggcgaacgacatactggcttccagtttgattttggggtggaacatgtgcgaggccttgcctaggaaggagatacggtcgaagctattattcggagtcgtaccatctacatgcttgtaagacaatgaggtataaaatgtcgttttctcattgcctccgctgatcgccacgtttgtattcgaactgaatcctttttgatatgccttgtggaagttattctttacgggagagtaggctcttgtggaaccgtcatagtattgtatctcacgtccatcgaatgcgggtccccacgacataccttgatcgttcatcaatgagaattgaccatttgcgttggtaggatattgtccgaagttgtcatagatgtaatagtctccattagcgtttttatcgccgtaatctacgttacctgcaatgataccgttaccgaattcgttttggaaactaggtgtttgggttatcacatccataccgaatgattgtgagatattgatacccagtccttgtccgctcttgccgcttttggtcgtgatcacgatcgcaccgttcaaaccgcgggaaccatagagggctgtggccgccgctcccttcaatacggatacagactcgaagtcatccgggttcaagtttttcaactcgttaccgtagtcattggggttggagtcccagtccggattaccttccttgatggagttgtccaagatcacgccatcgatcacatagatcggctggttgttctttcctaatgtggaagcaccgcggatctgaactttagaggaaccgaacataccaccatccgaacctgagatttccaaaccggccactttaccttgcaaggcggctaccgggttaatcaagttagcgttcaattcgtcgccttttatctctttcatggcgtagcctagggatttttccgagcgtttcatacccaaggcggtaacaactacctcgtccagtttttgcgtatcctcggcaagctttacgctgatggcctgccccttgtagataagctcttgggtcatgtatccgataaaggagatctggatcaagtctccgttatttactccttccaacgagaagttaccgttcatgtcggtaatcgttccattggttgtgccttttactactacagacgctccggctacaggcccgaaattatccactacaactcccgttacttttccgctctgcaaggaaatacttacgtctagtttctccggtaccaagtcggcatatgcgcttacaggcaacgccatagctcccactacgaggattagattgaccggcttaaagtttttcaacataactaatgattttttatggtaataaaattaactatctcttggcgaaacagcgtctattgtttggcgttgaaatctaaagttctgtggttggtgtatttcgtgttttattgatttttcacttaagtaccatgactactctgttctaaattgaaaatacctgataccttcaccatataagtttcgagtatactatttgaatatggtggaactaagttgtacgcaaacctccggtatgcacccaagcctttttttgcttattctttttcacttattaaggaaaacataagcaactatttgtaagcaaaaccaagcgaactcataataatttgttactttcgcggtggtttcaaataggacagtcaaaaaacaactaataaaaacatctatggcaaagattacaaaagaggaggcccttcggtaccatgccgagggcaaaccgggtaagatcgaggttatcccgacaaagcctcatagtacgcaaacggatttatccctggcttattcgccgggcgtagccgagccgtgtctggagatcgagaagaatccgctggacgcgtacgaatatacggcgaaaggtaatttggtagccgtaatctccaacggtaccgccgtactcgggctgggcgatatcggtcccttggccggtaagccggtgatggaaggcaagggattgctattcaagatattcgcaggcatcgacgtattcgatatcgaggtgaacgagaaagatccggagaagtttatccagaccgtgaaggcgatctcgcccacgttcggaggaatcaacttggaggatatcaaggcaccggagtgtttcgagatcgagactcgcctgaagaacgagctggatatccccgtcatgcacgacgaccagcatggtacggcaatcatctccggcgccgggctgatcaacgccttggagatcgccggcaagaagatcgaggacgtgaagatcgtggtgaacggcgccggagccgcctccatctcatgtacgaaactgtacgtgatgctgggagcgcgcaaggagaatatcgtcatgtgcgacagcaagggcgtcatctctaccagtcgcccggacttgaacgccgccaagcgggagttcgctaccgaccgtccgatcaagaccttgcaggaggccgtggtgggagccgacgtattcttgggcctctccgtggcgaacgtattgaccaaggaggtggtacgtagcatgaatgccgacccgatcgtattcgccttggcgaacccgaacccggagatctcctacgccgacgctatggcctcgcgggacgatatcatcttcgctaccggacgttccgactatccgaaccagatcaacaacgtgctgggattcccttatatcttccgcggcgccttggatacgcacgccaaggcgatcaacgaggagatgaagcgggccgccgtctacgccatcgccgaccttgccaaggagcctgtccccgacgtggtgaacgccgcctataagctgaaacgaaccactttcggacgcgactatatccttccgaaagcgctcgatccccgcttgctgacccgtgtatcttgcgccgtggcgaaagccgctatcgactcgggcgtgtctcgcaagacgatcaccgactgggagggctacgccaaccacttacgtgagatgatgggatacgataacaaactattgcgctcgttcaccgatatggcgaaagcgaacccaaaacgggtggtattcgccgaggcgaaccacgtgaatatgctgaaagccgccgccgaggcgaaagcggaaggtatctgtttcccgatcttgctgggtaacgaggagcgtctggccaagatcgccgccgaggagaatatcagtctggaaggtatcgagatcgtcaacctccgccacgaccgcgagacggaacgccgccaccgctacgcccgtattctttctgataagaaggcacgtgagggcgtgacttactcggaggcttgcgagaagatggtagaccgcaatgcgttcggtatgatgatggtggctaccggcgacgctgacgctttcgtgacgggcgtatacagccgctactcggaggttaccaagatggcggagcagatcatcggcatccgcccgagttacaagcatttcggtgccttgaacatcctgacttgtaagaagggtaccttcttcatggccgatacgctgatcaaccgtcacccgtcggccgaggtattgatcgatatcgcccgcctgacgcacgacgccgtgaagttcttcgctcacgagccggtgatggcgatgttgtcttactccaatttcggggccgacaagcagggcagtccgctgaaagtacacgaagcgatcgatttcttgcataagacatacccggacatggtagtagacggagagatgcaagtaaacttcgccctcgacaagaagttgcgcgacgatatgtatccgttcaacaagttgaaagggcaagacgtgaataccttgatcttcccgaacctaagctccgccaacagcgcgtacaagctattggatacgctgggtatcaccgagacgatcggcccgatccagatgggattgaacaaaccgatccacttcaccgacgtagaaagctctacccgtgatatcgtgaacctgactaccgtagctgtcgtagacgctatcgttcaggagcagatcgagaaagagaacagataagttttgatgcggatgacgcggataacacggataagaataaaataaatccgtgtcatccgcgtcatctgcgtctaaaagatagaccaccaagagttttgacacagggtcatgtcaatttagatagctttcgatattcgctattaccttttgcgacaatcgctccatacattgctccgagtggccggagactttcggggtatatatgacattatcgaattgcgtcaaggtatccgcataattcccaataccgacctcatcgcataagaagaaattccgcttatgggcgctaagccaacgttgtaaatccgggacacggaaagtaggccctaccgacgtattgatcaatatcttcagattaccgaacaaacgaaactcatccgcccccagaagaatcgtattacgaggcaagcaagtacataaaatatccacctccggcagcaactcccgcaaaggcaggtaagcgataccggcggcctcggcatccggcttacgggtacggctgaaataatagacctcagcccccaagaaacgaagagcgtcagcgatcattctcccggtgcggcccaatcccacgatgcctactttttgcccgcccagctcatacgccttatgtctccactgtttcccgccgaaaccatgcaacaaacggaccagctcgctaatgacatactccacgactccctcatcgccatagtcgcggatgcccaagaccgttatcccccgctcacgtgcggcggctatatccacattcgcgctagactcgctatagagggtacagcacatcccgatgtatttgatattcgggcaagcctcgatcacgttcctccggatctgtgtattataagagacgagtacgcaatctgcgtccccgatccggttcacaatctcctcatccgtttccggaatgccggtataaaaaacaacctcttttccaagctccttcaaacgctccactccccatgtattcaacccggtagaatccaccactactattttctcaaacatatctcacattattaattaccatcttcaattaattatccctctcacaaagctataaataaaatagccgcaaagggtaaccttcagcacgacactcaataaaaaacccgcgaacgccccgaaactagccttcaacgcatctccggacgccttgcctcccaaaagttccccaacgaaagcccccacgaaaggacccagcaagattccccaaggcggaaacacgaatatgccggccacggttcccacggcacatccccaatttccccacttggaccctccgctatacttagtccccagcatgggcgtaacatagtccatcgcctgtaccaacacgaccagcaatccccacacgaccaactccgtaaccgtaaattccgcataacccgtaaaatgcaacagccacaaagccaaatacgctaccggcggccccggcaagatcggcaaaaaacaccccgccaatcccaccaacaaacagataacgcctagtataaccaataagatatccatatatttcagtttttgggatatataaatagacaaagatacaaacatttcccacccttaactgttttgctaaaagctaaatctaaacatatatatttatgcacaaacatttacgcctgacatgttatgctttgttgtgcttgctggtaccgatcggggtaatggcgcagacagagcatacgtatttagaccgtgccctacccgggtcatggtctgaggaagggagtgatttccagcagacacttcccgtagaagataattggtggagaaattttaaggacccgttactggactcgctgatagaagtagccgtgaaacaaaactattccgtgcaaatggcgatggacaggatcgccatggcaaaagccaacctgcggtcggcacaaggaagctactcgcccaccctagggctttccgccggatggacacggcaacaaagtagcggcaatatcaatcaggtacccaaggcgatcacccaatattccagcgctaccgtagatatgaactgggaggtggacgtattcgggagtatccggaaccgggtgaaagcggagaaagagaatttcgccgcctcgaaagaggaatacaacgccgccatggtctccctttgcgctcaagtagcctcctcatacatcaatatgagggaactgcaacaagaggtaaaggtagcgcaacagaactgccgctcccaacagacggtcgtacagatcacccagaaacggtatgagaccgggctagtctccaaactggatgtagcgcaggcgcaatccgtatactacagcacgaaagcctccctaccgatgctggaggccggtatcatccaatacgcaaactccttggcgatcctgttaggcctgtacccttccgatctacaaaagatcatggagacagacgcttccttgccggaatatatcgagccggtcggtgtaggtttgccggcaaacctgttgctacgccgtccggatgtacgtgcggcagaacggcaggtcaatgcgcttgccgcctcgctcggggcctctaagtccgattggtggccgaaagtattcgtgaaaggctcgatcggtttcgcctcccacgacttcgacaagctggcgaatcataatagcttgacctatgagatcgcccctacccttacgtggaacttcttccaaggcacccagaagatacaggctacccggttggcgaaagcccagttggacgagtcgatccggcaattcaaccagaccgtgcttacctccgtacaggaagtggataacgccatgagctcgtacaagaactcgatcaagcagatcgtagccctccgggaagtggtaaaccaaggaaaacagaccttggatctttcccttgacctctataagcagggccttacgcctttccaaaacgtactggacgcgcaacgctccctcctcacctaccagaaccaattgacacaggctcaaggtagctcactactgaacttgatacagctttatcagtcattgggcggaggatggaatcctatgtaggccgttcgatccgatcgaacaaaagcccactcaaacaattaatataaataatcattaaagacaaaagatatgaagacatttgtttacatagggattatcggagcctccgccttattactggcgtcttgcaaggggaaaagcaagccgatggaaacgcccgtgccctccataagcgtatccacgccgatcgtgagggacattaccttgactaaagaataccccggataccttagttcacaactgaaagtagacttggtcgcacgtgtcaacggatacttgcgtacctcttacctcaaggccggaagccgggtgaagaagggcgatcttatcttcgtgatcgaaccggacacctatcaagataacgtcacccaagccgaggcttccgtaaagacctccaaagcccagctggaatatgcacgcagtaactacgagcgtatgaaggaggcggctaagagcggcgccgtaagccagatacaagtgatccaagcggaggctaccgtatcggagtctgaggctgccgtgaagaatgccgaggcggagttgaataccgcacggaccaacttgagctattgctatatccgtgcgcctttcgacggtgcggttacccgggccagctacgatataggtaattacatcaacggagccgtccagccggttaccttggccaccttatacaaggacgacttgatgttcgccaatttcaatatcgaggataaccagttcatgaagatgatgctggaagccgcccgcaacgatagcaccgtgaagcttccgaccgagatcctcgtcagcataggcaaggatggcggcaatgcgtatacgggccggctggattatctatcccccaatatcgacctatcgaccggtaccctgaacgtacgtgccaatctggataacccgaagcatgtattgaagagtggcttatatgtcaccatcaccctgccgtatgccgagcagccgaatgcggtcttggttcgcgacgcctcgatcggtaccgaccaattagggaagtacctttatatcgtgaacgactccaatgtcgtacgataccgtcctatcgaggtgggccaattggtagacgatacgcttcgccaagtgaccgccggtatcagccccaaagactcctatgtcacctccgccctgcttaaggtacgagatggcatgactatcaaacctataaaataagcaagctatggtaaagttctttattaacagaccgatattcgccaccgtacttgctctgatcatcgtcgtggcgggtttggtcaccctcaatatattaccgatcgcccagtatccggagatcacgccgcctaccgtacaggtatccgccgtttatcccggggcggacgcacagaccgtagcgcagaccgtaggtttaccgatcgagcaacaggtaaacggcgtggacggtatgctttacatgagttcaaactcctccagttcgggggcttactccctaacgatcaccttcgccgtgggaacggatatcgacatggcgaccgtcatggtgcaaaaccgggtgagtatcgcccaaagtagcttaccggaacccgtgatcgtacaaggtatcaccacccgcaagcaatcctccaatatcgtgatgatgcttaccctaagttccaaggattccatttacgacgggttgtatttaagtaattacgccaccttaaatatgatagaccagctaacccggctgccgggtgtaggctcggtacaggtgatgggagccggaaactacagcatgcgtatctggctagacccggaggcgatgcgtatccgtaacttgacgccggacatggtctatcaagccatatccacgcaaaacgcccaagtatccgccggttacgtaggccaaccgattctacgggcggataacccctatcaatataccttgaccgtgaaaggacggttgacgacaccggatgagttcggcaatattgtccttaagaccgggcaaggtggtaagatcctgcgattgaaggatatcgcccgcatagagttgggtagctcctcttacaacgtggtctctaaattaagcggacagccgacggcggcgatagcgatctaccagttgccgggctccaactccttggatgtatcgaaggtggtaaaggccaagatgaaagaattaggcagttccttacccgaaggcgtggaatacaaagtgaccttggatacgaccgaggtgatcgacgcctccatccatgaggtgcttatcacgttcttggagacaaccttgctggtggtcttggtcatcttcttattcttacagaatttccgggcggtagtcatcccgttcattacgattccggtctcattgatcggtacactggcggtcatggcggctttaggcttctccattaatacgttgaccttattcggcttgattctggcgatagcggtggtggtagacgacgccatcgtggtggtagagaactccacccggctcctcgataccgggaaatatacggcccatgaggcggtatcgaaggccatggatgagatcgtagggcctatcgtgggcgtggtattggtattattggcggtatttatcccgacaacgtttatcagcggtatctccgggcagctctataagcaattcgccttgacaatcgccgccgctaccgtattaagcggatttaactcgcttacgcttacgccctcgctttgcgcccttttcttggagaagaatacggaagaaccgaaattcttcctcttcaaaggattcaataaggtatacggaaagactcagaagatgtacgactcgatcgtggagcggatgctgaaacgaccgggagcggcgatgatcgtttacggtatcatcacggcggtagcggttatcttgtttatgcgttggccgacaacctttatacccgaagaggatgacggctatttcctagtcgtatcccaattacccccggcggcgagcttgaaccggacggaggcggtcaccaagcagattgacgagatcctaaagacgtaccccgaggtgaaatcattcatcagcgttagcggattctccgtaatgggtggaggggagcaatccaatacggccaccttcttcgtgatcctaaagaactggaacgaacgtaaaggtaaggagcatacggcagaggccgtgaccaaccgtttcaaccgggaggcatcggctatccaagaagcgcaggtattcggtatggtaccgccagctatcccggggttgggcgcttcgggcggcttgcaactgcaattggaggatcgtaagaacctaggtccgacggagatgcagcatgccgtggagacattgctggccagctaccgctcgaaaccgcaattgctgaacctttcttgtatgtatcaggccaataccccgcagtatctactgaagatagaccgggataaggtgcagatgctcggtcttcagttgaatcaagtattctccacgctcagctattatatgggagcggcgtacgtgaacgatttcgtggagttcggacgtatttaccaagttaagatcgaggcgaacggagaggcgcagaaagtgatcgatgatgtactccgtttgagtctggcgaatagtaaaggagagatggtacccttctcctcttttatcgaattagacgagcaattgggattagaccagatcaacctatataatatgtattcatcggcggctattacttgtatcgccaacccgaaatatagctccggagaagcgatcctagcgatggaggagctgatacaggagcaattaggtgataattttggatatgaatggacctcggtcgcttatcaagagacgaaagcaggatctacgacggtgattattttcgccatggcgttgctagtcgctttcttggttctctcggctcaatatgagagctggacaagtccgttggcggctatcatgggtttgccgatcgccttgttgggagctattatcggctgctgggtgatgggggttccggtaagcgtatatacccagatcggtattatcttattgatcgccttgtccgccaagaatggtatcttgatcgtagagttcgcccgggatttccgaaaggaaggtaatccgatacgggattccgccttggaagccggacacgttcgtttacgtccgatcctgatgacctcgttcgcctttgtattgggtgtcatgcctttgcttttcgctaccggagcgggagcggccagccgtatatccttaggtgcggcggtagtattcggtatggctatcaatacgatattcgccacgatgttcatccctaacttctatgaactgatgcagaccatccaagagaaatggctggataaaggaaagaagacggatgatacgcctaaacaatagaaagtttccaatcctctaatgaggcaaaaagagaatagccatggctaaacccatggttattcttttttactcccttcggatacattattatatattctatgattggaattaggcgattcccaacaactctacctcaaatattaatgtggagaaagcagggatcggagccgaggcacgattaccataaccaaaattgtaagggatatagattatccatctatcccctacccgcatttcttgaagagccaattgccagccttcaatcacttggttcaagcgaaaggcttccgggcaaccccgtttccatgagttatcaaattcccttccgttaatcaacgttcctttataatgtacggaaacgacgctttcccgattaggagagactttgcctgtacccgcttgtattaccttatataatataccgcacggtaatgtccgggttccctcttccgaagcgatctcgtccaaatacaatagattcttctctttgtactcctcttttctactcatatatattacattatcttacatttagctccgcaaatgtagcaaatagaaatagaaactcaatggcatggtaacacaatagacatgccaaacgttcaaatactatcattatatgaatctgattcccgctttttttatcatagatcaagaaaacataggaatccgcaaaaaacatgctataaaacataccacgtatggaataacgccgtatatttgtgtcgtaaaacataattgtaaagcaaatatggtaaagagattgtttaaacgttacatcgatttgctagggtttcaaccttggacaatttgggtttaccgcatgtggtaaacctcacgatgaaaaagaggaaggtttaggttaaggttatcagaagtccgggattaggttagtaataggttaaaaggttaaaggtttaggttttcaattcattcgttactcggacttcaaaagttatgtgagatttagaacgtgtcgaaaggcacagatttattaattaaaaagaaaatgagctatgaaaagttttattagacattttttggatagctgcttgagatcactcgctgctatcggtcagtcggagttaacaaaatggggttacaataaataagtaacaccccattttaccgggaaggtgaacatttgattttttcaaaccataccgcggttgcttggcatcttgccagacaatcgcttttttgtatccataccttttaaacaaggtatcttagtttcatcgagaaagtatcctaagttcattggcgaagtatcttaggtgtatggggcgatgaaactaagatacttttataactcatgcgcctatccccactgagtttctactacccgtctatatatttatagatattaactatttgacaactgtctaacaacatcttatttttgtcaagaagttaaaaacaattgttgtttctaaacagttttatttaaagattactttatctaaaattctttattgcgacataaaaactaaagttatggaagacaaaaaactaactgccgccaacgggcgccctgttgcggacaatcagaacgtacaaacagtggggccacgtggcccgatggtattacaagacccttggttcattgagaagctagcgcacttcgaccgtgaagtgatcccagaaagacgcatgcacgccaaaggttccggcgcattcggtacctttaccgttacacatgatatcacaaagtatacgaaagcggctattttcagcgaggtaggcaagaaaactgactgctttgtccgtttctccaccgtagccggagagcgtggagcagccgacgcagagcgtgatatccgtggattcgccatgaaattctacacagaggagggtaactgggacttggtaggtaacaacacccccgtattcttcttgcgtgatcccctaaagttcccggacttgaatcatgcggtcaaacgtgacccgaaaacgaatctacgaagcgaggataacaactgggatttctggactttgcttcccgaggccctgcatcaagtaacgattacgatgagttctcgcggcattccttactcttatcgacatatgcatggtttcggtagccatacgtacagttttatcaacaataagaacgaacgtatctgggtgaagttccatctcagaaccctgcaaggtatcaagaacttgagtgacgaggaagcggctgcgatcatcgccaaggatcgtgaatcccatcagcgtgatttgttcgagagtatcgagcgtggggacttcccgaaatggaaattccagatccaattgatgactgaggagcaggccgagacctatccgatcaacccgttcgacctcacgaaagtatggccgcataaggacttcccgttaatggatgtcggtatcctcgagttgaaccgtaatccggagaattatttccaagacgtggagcaagccgcattcaacccgatgaatactgtcgaaggcatcggcttctccccagacaagatgttacaaggtcgtctattctcttatggcgacgcccagcgttaccgccttggcgtgaacctagagcagatcccggtgaacaagccccgttgtccgttccatgcctatcaccgtgacggagcgatgcgtgtagacggaaactatggagccgcaaagggttacgaacctaacagcttcggcgaatggaaagactctcccgagaagaaggaaccgcctttgaaagtacacggggatgtttataattacaacgagcgtgagtacgatgatgattactacagccaaccgggtgccttattccgtttgatgccgccggaagagcaacagttgttattcggaaataccgcccgtgcgatgggtaacgcccaactgttcatcaagcaacgccacgtacgcaattgctacaaggcagaccctgcttacggtaagggagtagctgaagctctaggaatcagcttagaagaggccttgaaagaagaccgataaagtagtaaggctacgatagaaagcgataaaagagggataaccccagtaatcctatggatgaacaggttatctcattcttttttagtaggataagagaggatatgccatgagaccccgatactgataagccctaacaaagctttcacccaccaatagccgactagcaaaagggaagtaatgatcgtagatagccacatgatagcgatcgtgataatcttggaacgcaaaggaatagccttatcttccacaaagcccttaatatgcggcccgaaataacgattgctcatcacccggttataaagcttctccgagctacggacataaaaccaacaagtcagtaaccaaaaaggagtggtcgggagcaaagggacaaagataccgatcgctcccaatatgagaaaaaacgttcctaacgtaatgtatatgatacgtctcgtcccgttcatcagccaaccgtatattccgcgatttgcttgaaaccattcaggaagtccgttatattcatccgtttctttccggcaagttgcaaggaacgcaagcgaagaaaaccgtccttcacggccacgtcgatatacgatttatgatccgtatggatagagccgaccgggaagttatgctccgccggacgtttctctgcctggtaaatctttaaagccagacgtttgccatcctcagagatcaattccgtccaagcagcaggataaggagaaagcccacggacgaaatcatagatattcttcaccggctggttccagtcgatatgacaggtatccttgaatatcttcggggccggacgcaactcggcggcatccttatagaattcctcttggggaatagcgtctgtttttccatccaacagtaagtccacggtctcggtaaccaaccccgcccccatcaccatcaaggcatcgtgaacggtttctacatcgtcggtatcagcgatcggcagatgtctctgacggatgatcttacccgtatcgatctcatgcgtaagaaagaaagtagtcacgccggtctccgtatcaccattgataaccgcccagttgatcggagcggcaccccggtattgcggaagcaaggaggcatgcagattaaaagttcccagacggggcatattccagaccacctccggcagcatacgaaacgccaccacgatctgcaaatccgcccgcaaggcacgcagttcctccaaaaacgcctcatccttcaacttctctggctgtaagaccggaagacccaccgatacggcatattgcttcacggcactcggttgaagcacgctaccatgacggcccatcggcttatccggcatcgtaatgacacctaccacattatatccaccttctaccaaggcacgcaggctctccacggcaaaatcgggagtgcccatatatacgattcgtaaatcctctttcttcatgtacaataaattggatctgtttttaacaagttagtccccggaaaagttatcgaccaatacctcccgataggaattaaatatcttcgatttcgacataaagccgatataatggccattctcatcgaccaccggaagattccacgctttcgtatcgtcaaacgtctgcatgatctgatccatcggcgtgttgattacgatcttggccggggcggaaaccatgaacttcgatacatggaaacgattatacaactccggacggaacatgatattccggatattatccagcaagacgatacccagcaacacgccccgctcgtccacaacagggaaggtgttacgcccgcttcgggaaataacctttaccatatcgcccaacgtcatctccggagacaccatctggaaatctttctcgatcacgctatccgcccgtagcaaggtaagcaccgccctatccttatggtgcgtcagcaactcgcctttctgcgccaaacgcatggagtagatgctatgaggctcgaacataaggatcgtgatataggaactgatcgagacgatcatcaaggggaggaacaaatcatacccacccgtcagctcggcaatcaagaaaaccccggtcaaaggagcgtgcatcaccccggacataatgcccgccatacccagcaaagcgaaattcttctctgagatatacatcgtgaacgggaaataattagacgtatgcgcaaagataaaaccggcgatacagcccagatacaaactaggagcgaagataccaccgcaaccccctccggcattcgtggcgctggaagcgaataccttcgtaagcaagatcaaggtcaagaagatcaagaccccgaaatacgtatcgttcagatcgtaaaacaaactcttgtccatgatatgcgagaactgcccgttcagcaacgagccgatcgtatcatagccctcaccatatagtggggggaacaggaatatcaagatactcagcatcacgccgcccaacatgaacttcttccaatacgtacccaacttccggtacatcccttccaccttgttcatcacacgggtaaaataaagggataccaatccgcaaaaaacacccagcaagagcacgtaaggaatacgctcgatctcgaatgcctcggtctgagagaacttaaacatggcctcggtgccggtaaagatataagacatcgtagccgccgtcaccgacgagatcagcaaaggaagcacggaagtcatcgtaaggtccagcatcaatacctcaatcacgaacaccaacccggcgataggcgccttgaagataccggcgatcgctccggcggcaccacatcccacgagcaacatcaacgtcttctgctccatcctgaacacccgtcccagattagaaccgatagccgcccctgtcaatacgataggagcctccgccccgaccgatccaccaaagccgatcgtcacggaactggctacgatagacgtccatgtattatgcggcttgatacggctctttcgttgcgagatggcatacaagatcttcgtcaccccatggccgatatcgtcacgcacgatatatttcacgaacaagccggccaacaagataccgatcaccggataaagcaaatagagatagttcacgccgtcagcactgaaattacccgtcaatacatgttgtatgaaatggatcaattgtttcaatatgatagcggccgcagctgtgcaaattcccacgataaagctgataataaggataaaatgcttctccttgatgcgcttttcccgccataacaacaatttatagaataacccttcgttagccattttaaatacctttacctgtaaacactgttttaactgtataaatgagaatcgttatgtccagaatcaaggacatattctcatagtataatatatcatattccaagcgctcgatcatctcatccacgctgccggcatatccatatttcaccatacccaacgaggtgattcccggacgtacattatgcagcagatagtagaagggggctttcctcacgatccgctcgatgaaatatttacgttccggacgggggccaactagcgacatatcccctttcagcacgttccagaactgcggtaactcgtccaagcggtatttccgcatcacccgtccgaagggagtgatacgggaatcgtcctcggaagagagcaacgggccttcctcctcggcgttcgtgtacatcgtacggaacttatagatcatgaaaggctcgcccatgtatccgatccgttcctgactgaaaaacaccgggccgggggaatcccgcttcacccgccaagcgatatacaggaacaagggagataagagcaccaagaaaatcagagataacgtcttatccataaagagctttacattctgctcgatgggcaagaagttgttatccgtcacgtccaccagcggaacgccctttatcgccttgatctttacttgcgataatgaactggatttatccgccaatatcttgatcggccgtttataacaatataacgaatacaggatatccatcaaacggttattatccaccgtctccaaggcgacaaccagctcatccacctttttctcctctacgatcaccggcaaagattctagcctaccgatcacacgatctccggcgaccccgccctttttctccgtaccatcggagacaaaaccgacgatattataacccaaaccatacaggtcgtcggcaatacacgccgccttcttccccgccccaatcatcaatacattcaacgcccattccctgcactttatcttccgtaacccggcctgcgtaatcaataaccggggaatatacgtcaagacaaactgcaatccccataaagagaaaaacatatcataatacacgtgataagaacggggcaagtcattcagcactaaggcaaaaaacaagatcacgacaccgatcgacacgctcccaagggtagagaacaactcagtaagcctcgacttaccgaacggtttattataataaccggaaaaccaatataatacgaaccagaaaaacgggatcaatagctgccccttcaatgaggggatatgcagcaaaaaggccccgacggtatcaaacccttcatacaccgccacctcctcatagcgtatcaggttaaataataaccagactaccgacgacgctataaaatccgagacaatatattttccggcttgtacgcttttcttcatccttatctaattacctgcacaagcccaccggctcctaacttgataatgccggacggagcggccttgctcatatcgtcctgacgataactcacgatataatccacaccctccttgatcacctccgatacctcgctgaaattagcgggagaaggctcgccgcttacgttggcggaagtagagaccaaaggtttacggaagcgctcgcacaatttcttggagaactcctcgttcgtgatacggatacccacgctaccatcggctcccaatagatttgtcgccaagttcttggcacttgagtaaatgatggtcaacggcttatcagacacgctaatcaaatcccaagcgatatcgggaacatccgacacgtacctatccaatttagcctcgctgtccatcaagaccaacatagccttattgtctgtccttcgctttagctcgtacactctttgtacggctttttcattggtagcgtcgcaaccaattccccagatagtgtctgtaggataaagtattatgccgcctgcggccattacttcgcaagcttttttaatatcttccgtcattgtattttataatatttaggcaaatgtacgaatcattctcctacttcaaaaaaataataacaaaaaaactattttctttaagccataccggatataccatatttaatttctaactttacgggttgaaatatattgcggaaatctcgcctttgtcatacggtagattaaggatgacaaggtatccgtagtatcaggcaagcaaaaaagaaaaaaacaatatataatgattaacaaatggaactttcaaaccccatcagaagaagagttacataagagagaccaattggtggctgaattaggattcagcccggtgatctgtctcttgctcgttcaacgaggtatcacttcgatcgaagaggcgaagaaattctttaaacccagcttgaacgatttgcacgacccgttccttatgccggatatggataaggcggtgaggcgcttgaacaaagccttggggaataaagaaaagattttgatctacggcgattacgacgtggatggaacgacagcggtatcgctcgtcttcaagtatttaagaccttactcgtctaccttggatttctatatcccggaccggtacgacgaggggtacggtatctcttacaagggtatcgattatgccgccgagaacggcgtgtcgctggttatctcgctggattgcggtatcaaagcgatcgagaagatcgagtacgccaaggagaaaggcatcgactttattatttgcgaccaccatatgccggacgccactttgccggacgctgtcgccgtattggatgccaagcgctcggattctatctatccgtatgagcacttatcgggttgcggagtaggattcaagttcatgcaggcgttcgccaagagcaataatttcccgttctcggatctggagaagttgttggagctgacggcggtcagtatcgcctcggatatcgtcccgattacgggagagaaccgcatcctcgcctattacgggctgaagcaattgaacagcaaccccagcctcgggctgaaagggattatcgatatctgcggattgaccggaaaggagatcacgatcagtgatatcgtcttcaagatcggtccccgtatcaacgcttccggccgtatgatgaacgggaaggaggcggtggaactgctactgtccaaggatagcgccagtgcccgggagaagagcgagagcatcaaccaatataatgaggaacgccgggaattggacaagaagatcaccgacgaggctaacgctgtcatcgacgaagtagagaacatggatgaccggaaggcgatcgtggtgtataacccgggatggcacaaaggcgtgatcggtatcgtagcgtcccgtttgaccgagaagtattaccgtccggcggtcgttcttaccaaatcgtccgagttgatcaccggatcggcacgttccgtaacaggcttcgatatttacaaggcgatagagagttgccgggatttattggagaatttcgggggacatacctacgccgccgggctttcccttcgggaggagaacctagaggcattcaccgagcgtttcttgaagatcgcatccgaggagatcataccggagcagatgatcccgcagatcgatatcgacgctatcttggatttgaaagagatcaaccagaagttcgtgaacgacctaaagaagatgagcccgttcgggccggacaaccaaaagcccgtattctgttcgcttggcgtaaaggactacggcaccagtaagctcgtgggtaaggaactggagcatctcaagctggaattgatcgacggaaactcaagcacccccatgcacgccatcgctttcggcatgcacaggtacaacgaccatatcaagggtatgaagcctttcaacatctgctacacggtggaggagaacacctacaacggcaacacctctatccagctgatgatcaaagacatcaaacccgacgatatatgaggaggacaggtggacgtttaccataagatattagagaagtattggggataccctgcttttcgccccttgcaggaggatattatccattccgtctgtgccggaaaagatacgcttgggctgatgcctacgggtggtggtaaatccatcacctttcaggtgccggcattggcgatggaggggatttgcatcgtcgtcactcccttgatcgcattgatgaaagaccaagtggagaacttacgccgggtcggcatcaaggctacggccgtttattcgggcatgagccggcaagagatcatcacgcaactggagaattgcatcttcggggggtataagttcttatatgtctccccggagcggcttagtacggatattttccgggtcaagatggaggccatgcaggtttgtctgctggtaatcgacgagagtcactgtatctcgcaatggggatatgatttccgtccttcttatctcaatatcgctgagatccgggacttattgccgggtgttccggtattagccttgaccgccacggctaccccggaagtggtgaatgacatacaagagcgtctgcggttcaaggagaagaacgtatttcaaaagagcttcgcccgcaaaaatctggcttatattgtccggaagacggaggataagttaaatacactcgtttatatattgggaaaagttccgggtacggccatcgtatatgtccgcaaccggaaacgcaccaaggagatcgccctcatgctgcaacaggcgggtatctccgccgatttcttccatgccgggttaaaccgtgacgagaaagaactgcgtcaggcccgttggaaaaacaacgagtgccgggtaatcgtatcgaccaacgcttttggtatgggtatcgataagccggacgtgcgattggtcgtgcatatggatatgccgggatcgttggaggaatattatcaagaggccggacgcggggggcgtgatgagaagaaagccttcgccgtggctctttgttcctccacggatagcgccaagctaaagaaacggctggcggatgagtttccggacaaggagtttatctatcgggtctatgaggcgttgggtaattattaccagatcgccgtagggtacgggctagatacggtacacgatttctcattgacggatttctgttccgcttataagttctctttattgcaagcgcatcatgccttgaagatccttgggctatcgggctatatcgaatatacggaggaggtagacaacgcttcccgcctgatgttcacagctacccgtgacgagctttacaggtatttaagtgagaacaagcgaacggatgaggtgattcagacaatcttgcgttcttacaccgggttattcgcagattatgtttatatagatgagagcgtaatcgccacccgtgcgagagtgacacctcacgaggtgtatgagaccttggtaggtttatccagataccggatcgtaaactacatcccgcataagaaaaccccgttgattatctatacccagacccgggaggaacagcggtacctttccataccccgctcggcgtatgaggaacgcaaggagcgtttcgggaaacggatcgagaaggtgctggaatatatcaacgaggagcgggtatgccgtagccgcatgctcctatcctatttcggcgaggaagattccgccccttgtggctgttgcgacgtatgcctatcgaagcatgaatcacagcttatgaattgggaattcaacgctatccgggaaagtctcataaagatattggccggggaatcccctatccccgtgaaagaacttattgagaaattacctttccctcaagagaaaatcctcacggccatccgctttctggcggatcaagattctcaattcacattaagcgacggctatctatcgcacgaggattcagcaaaatagcacgatgcccatcgtaagctccttagaatgcccattgttagcttgctagaatgcccatcataaggagcttacaatgggcattctaataaaccatgtatcaccgcttataattactccgattagatacttgtttttccgtcgggaaatcagcgggaaccttttgggttaccttgccggtagcggcccattccgcacctcttaacaaggtaatctggaagccggcgcattgcatagccggacaattctctaccgtttcccccgcgtgccctaacatcgtatgaaatatacgggcattcccataatcaaccgtaaagatcaacggctcctcacggccggaacctccggtctccttatccgaataagccgtatacaagcaatcctttatatttcccgggccacgcatacgatcatataactcatcctgcgcatgtttccatttattcggcaaccccttcatgatcggatgctcatggttccgggcattcagcacatactcatgttgcttgccatgagagccacccacgcccgccgagctatcctttatcaacttaccatcgctccaatatacatagggtcccgctttctcatcccggttctcccaaccgcccaaggcacaaatcttattgtattccggccagttcacgaaggcgttatcagcggcatgatagatcacgacacctccacccccttgcacatactccaagaaacggcggttcgtctcctccggccaagcatccccattataatccagcaccaccagctcgtaaggactgaaatccaagacaaagccggacatatccttccccgcctccggagagaccgcaaaatccacggagaagcgtcccgagttctccaatatctgtttaagcaccacatggctcacctgccaattatggttattctgccccgttattaataacgtcttgatcggcttacgggccgacatgccgcatacaaccagtaaagcggccaaaaggaaaacgaccttcctacaaaatacatgtctcatggtatgaatcagatttaagtaaacaattgattatccgtctttatttatcataacaaagggaagcggcaccgaatagccccggattctccagcttagagaaacgtatcttcaagttcttgatagagttcggataagcgaaatccttcaagtcctcatacatgctctcctcaaacaactcatgggcggcggtcaccgagcctccgaagacgatcatctccggatctaccgtcaataccacgatcttgatagcggcggccacatgtacgcccaactgccggtaagcctccagcgcctgctcgtccttccgcatcgcacgggtgtacatctccttcccatccacgccccatacgttcatgaaataggaaccgctacagaaatattccaagatctgtccttggtacggaatcatgccaaactctcccgagccacaattagcgtcggccaacagcttgccattctggataattccaccccccaagcccgtacccaaggtgaggcccacgaagttatcaaccgtctttccttcgccaaagatacgctcacccagagcgaagcaattcgcgtcgttatccacataaaccggcacggagaagcaagcctccaagatctccttcaaatgtacctcctcccaatgcgggatattcaccacgttatatacgatccccttctcacgatccaccacactcggcacaccgataccgatagctaccacactctcgtcccacacggaacggatcacctctatcaaagcctccaatgtctccccgcaatccgcggcgtccttgggagtcggggcgctcccctgagccactaatcgatcccctacgatacggccggcacgcatattcgtcccccctaaatccactccgatataagcgtttttcttctctacactcattctttccacgatattaaattagattatactcccacaaagctaacaaaaaaggcaatgttacgaataacatcgccttttaaactgataaatttaatacatctatgctttttattttccccggcgtcaactccatccagcacgtataccgacatcgcctcacgcctacgctctcataggccaacgtcgatatacgtgtgaggcaatgccgatatacgtgtaagacggcaccattataactaccgcatcaagcgaagaacaagatcaataattgcgccgtaagtaccctcaagaacatggtcaaggggtataccgtagcgtaacctacggaaggagcgtcgtttccagccgtagcgttcgagtaagccaaagcgggcggatccgtcgtactaccggcgatcaagcccattaaggtgaaataattgatcttatagaaataacggcctacacaaccgatgatcagcaaaggaatcgtcgtgataatgaaaccgtaaccgatccaagcgaatccaccattgttcacgatcgtatccacaaaaccatcgccggcactgatacccacacaagcgaggaagagggtgataccgatctcacgcaacatcaagtttgcgctctgggtcgtataggtaaccaacttatagcggtaaccgaaacggctgatcaagatcgccacgatcaacggacctcccgccaaacctaacttaaccggttgcggaatgcccgggaacgtgataggaatactccccaagacaataccgagggcaatgccgataaagatcgtgatcaagttcggctcgttcaaacgtttcatggagttacccaataccttctccacgttagacacggccgtctcggtacctaccacattcacacggtcgcccacctgcaacgtcagacccggcgtagctaccaaatccacgcccgcacggttgatacgggtgatattgataccgtataacttgcgtaatttcaattgtcccagtttcttgccattcaaatccggctttgtaatcaagatacgtcggttgataaactggctttccatacgaatccattgcttacgctccatgtcaatctcctcgccgatgaatgtctttacggaatcggcatcttgatcggtcgtgatcacgaaaatcttatcatcctcattcaagatcgtaccggcggaagcgatctcgatctgcttgttatcattacgccatacacgggagatcacgaaatccagatgatccatcaaaccggataactcccctaccgtcttaccgaaaaccgccgggttctttacgaccagcgagatcggcttcgcctcattcgtatgcgaggcatcctccttattcaaatcgtcattctccttatcgaaattcacacggaatacgtaacgtacgaaaatgatcgaaagaataataccgatcacgcccagcggataagccacggcgtaacccaaggcgatcgtattatcagaaaccccgtacatatcggaataagcctgctgagccgcacccaatcccggagtattcgtcaccgcacccgataaaatacccaccatcgtaggcatcggaatacctgtcacgaaatgcaataccaaagccgtagccacgccaaggaagacaattccacaggcaagcatattcaacgtgatccccccctgcttaaacgacgagaagaaacccggccctacttgcatacctaccgaataaacaaataagatcaatccaaattccttaaagaaatgaatcacattgtggttaaccgtaaacccgaaatgccctaaaataataccaacaaacaacaccaaggtaatcccaagtgaaatcccaaatacctttatctttcctaactggatgccggcggcaatcacgaaagatagtaaaagaatggagtgcccgataccttctccccataataaatcgtttatccaatccatgccaaaatctttaaaaatcttattacctattaataaagacgcgaagttaggcatttactttgtgttttacaacataacgcctatatttacctttcaaattaaaatctcatgaaaaagatctattatattttatcagcactattcctatgcttgacagccacctctgcgcaagaagcgggaaagacagtcgtgattaaaaccaacgtaggtacgatgaaagccatcctgtacgatgatgtgcctaatcacacccgtactttcatcgaacgggcaaaacggggggatttcaacgggaccttattcacccgtgtcctgccggagtttatgatccaaggaggagccccggattccaagaacgctcccgccggtgccaaatgcggctttggagatccttccgccgagataccgcccgagatcaacgagaaatatttccataagaaaggagccttggccgctccccgccaaccggacgatatcaacccgcaaaagaaatcggatatgtcgcaattctttatcgtgcaggggaaggtctatagggaaaccgaactggatacgttagagcgtaccgccaactatccggcccggcaaaaggccctgaaggagttttacgcgccggtacgtgcggagctgaatatgataaagatgagtaacaaacgggagtaccagaagcgattgagagcgatcaacgcccaaatagactccgttattcaagcaactcccgggcatttgctatttacggacgagcaacggaaggcttataccaccgtaggcggttgccatcatctggacggcacttatacgatcttcggggagctgacggaggggttcgacgttctggatcagatcgccacccagccgaaagaccagaatgaccgtccgaagaaagacatccgcatccaaagtataacgatcgaataattcaccactcctatgttaaagagagatttcatcatggtacagatcgaggaactgggcaaagtgatcgctcagatcatcttcaatcgtaattccaacgatggggcacgcaagaaccccgagttaatccaatccgtctacacatccttaaaactggataacgatttcttgctgaacacgcctatcgacggcatccgcacttatctggacggtgatgactcgtgtggcctccaacgcatggagctggcgaccaagaccttgctggaagaaagtttccttttgccggaggcgcaaggtaataaactccgggcaagagcgaaagagctattggaatatatccaacgcaacgacactacgttctcgttggaacgagtggcgttgctggaagagataaataactattgaatagattgcggatcggtggtagggccttccacgactagaaggccattctcatcgattcgcattttatcgatgaatacgacccgctcatcccctgtcttctgggtacgcccgtgataaacgcaatacatttgttttccgtccttcgaccaagtaacgctattatgtccggtacccgtgacgataccgcctttttccacgttcttctccagcaccggattattagatgccttctcaaacggtcctaacggatgttcggacacggcatatcccaccgcataatttgccccgccaaaataattagcggaatacatcatataatacaagccgttgtgacgtagcatgaaagagccttccgtccaacgacgtccgacctcccctttggtaaccgagcgactttcccattcactttgcgcatcatccaattttacgggtggacgcagcagaagtacgggttccccaatcacgtgcgtaagatccggagcgacctccaccccgtaaatccagctttcctcaacggagtcgaacatgcctttcttctttgcctcatcggcgatctcgctttctaccggatgcttatagcaacaacgggaataatagagataggtacggccatcctcatcctcgatcaagtttccgtcgattacaggatatcccggatcgaacaaaggagcatcggccaattccttaaatggtccggtcggcttatccgacacagctacgccgatacggaaattttcctcctcgttggtcggattcttccgccaatccgcgctgaagaacatatagaacttcccgtcacgctcgtacacttccggcgcccagaaattagcgattgcccaagaatcgggcgtattaccccgataaacctgcccttccgacttccaatggatcaaatcatcggaagaataggcgcaaaaaccgtctacagccccggcaccggtaccatacatataataacgtccgtccgaggccaacaatacgtatggatcgccaaactggaccgacaaaggattactgtacgttaattccggctcttccgcagcagacttctttcccgtacaacccgcattcaaacacataagaactcccagacaaagggatattcctattttcataccacttttcatttttcttatttattggattctaaattatacactccttccgcacaacgttccccgtcgatggcagcggatacgattcctcccgcataccccgctccctcaccgcaagggaaaagaccttttaccgtgacgtgttgataggtatcccgatcacggacgatacgaaccggagcggatgtacgggtctctacgccgatcatggttgcctcgttggtcaagaagcctctagagaccttaccgaaataacggaaaccttcccgcaggcgactggtcacgaattccggcatccaaaaatgcaacggagaggccagcagacccggcgtatacgaggaaaccggtaaatcgaaagagttcttcttccgcatgaaatcatccatgcgctgggcgggagccgtttgcttcatgcctccattcaaccaacagacctcttccagacgttcctgaaaggccatcaacgctaatggggagtccgcatccaccttctcgccattccgaagataaagctcctcctgccctaccagttcggaataatcttccggacggatctctaccaccatccctgagttagaccagcgggaaccccggttagaaggcgacattccatttaccacgacctgcttaggtccgctcgccgcaggaactacgaaacctcccggacacatacagaaggaatagacgccccggttattcgcttgcgtcacaaaactatactctgccgcaggaagatatttcccacgaccttctttccgatgatactggatttggtcgatcaattcctgaggatgttccagacgaacaccgactgcgatccctttcgcctcgatctggatctggcgttcgtataaatagttatagacatcacgggcggaatggccggtagctaagataacaggcccgtaaaagctctttcccgtattcgtctcgatgccgatcacctcgttctctttcatgataaaagcatccatacgggtctcgaaatgtacctcacctccgcatcgcttgatttgctcccggatattctcgatcacacgggggagcttatcggttccgatatgcggatgggcatccgccaagatagagggacttgccccaaactggcaaaagatattcagtatcttatctaccgagcctcttttcttgctacgggtatacagctttccatcagaataagcgccggcaccgccctcaccaaaactataatttgattctccgttcaccttatgctcacgactgatcaaggcgatatctttcttgcgttcccgcacgtccttacctcgctcgacgatgatggggcgcaaacctaactctatcaagcgcaaggcggcgaacagacctcccggaccggctcctacgacgatcacaggtttccctgccgagacatctttatactctatcaattgatattccggctcgctaggcatctcgttcatgaaaacacgcagtttcacgttgacaaatatcgttcgctggcgtgcgtctatcgaacgtttcaatacacgtacggcccggatatttttcggagcctcacccgtctcacgggctactacttgccttagcgattgctcattaacagcctcttccggcaatatcctgagttgtaattcttttatcattgtttattatatattaaccgaatagttgccgaaaggcttcctccactttctttacctgtacgatttgaatcttgctcttcgccgtatcgaaaccttttagattattatgcggaatgataatccgggagaaacccagcttctccgcctccaagatacgttgctcaatacggttgaccggacggatctctccggacaagcccacctcgccagccatacaaacacccggctcgatgctgatatccaagctagaagaaaggatggaactgattaccgccaaatcgatagccggatcattcactttcaaacctccggcgatattcaggaaaacatctttctggatcaacttaaaacccgcccttttctccaatactgccaataacatattcattcggcgtaaatcgaatccggtggcgctacgttgcggcgtaccgtaaaccgccgagctgaccaaggcttgcgtctcgatcaagaaaggacgtaccccctcgatagcggcggcgatggcgacaccgctcagtccctcatgattctgggttaataataactcggatggattgctgacctcacgaagcccgttctggcgcatctcgtaaatccctagttccgccgtactgccaaaacggttcttgatgctccgcaggatacgatacatataatgctgatcgccctcaaactgcaacaccgtatccacgatatgctccaataccttcggaccggcgatactgccttccttattgatatggccgatcaataagaccgggacaccgctttccttggcgtatttcaagatagcggcactacactcacgtacttgggaaacactgccgggggaagattccacgacttccgtaaagatggtttgtatggaatctatgatcatcaagtccggctggatattggccgcttgcgtaaaaatctgttccagatgcgtctcgcataggatgaaacagttcggattatcatgcgataatcggtccgcccggagtttcaactggcgactgctctcctcgcccgagacatatagggttttcaagcctgtcaagcccaacacggtttgcaagaccaaggtagattttccgattcccggctctccaccgatcaagaccaaagagcccttcaccaagcctccgccgaggaccctatttaattcatcatcttttaaatcgatacgggcctcctcttccgtcgttatatcacgcaataacaccggacggatcttattgccctccataataccgggaactggccgcttcacggcaggctcctttgttacgatctcctctacataagtgttccactccccacaattcgggcatttacccagccatttcggggaatcagcgccacagttagagcagacatatacggtttttgttttcgccattctatcctgaatttggcgtaaagatacaaaaaactacttttcccctaccacaacgatcttctttccgataccgcagcccttcttaatttccgggctacctttctccttatacaagaatccgcggaacataccgccactgttataaggcatggcgatatttcctagtttatccacggcgatcaagccgccgttgccggcgttcgtattcaattccgtatggatgatataatccgccgctttctctacgctttccttaaggtatttatagcgggcacacacatcgaacgctaccgcatgacggataaaatactcgccatgccccgtacaggagacggcgcaactgttattatccgcatacgttcccgccccgatcacgggcgaatcaccgatacgcccccaacgtttcttgaacataccgccggtactggtcccggccgttaagtttccttgcttatccagaacgacacagcctaccgtaccgttcttcttactttcttgctttaacttctcgatccactccatcgtcttgggcgtagcgaaatacatattgtcttctaccatttccaagccttgttccttggcgaactcctcagcaccggctccgctcagcatgacatgcggagattttgtctttacggcataggcggcattgatcggatgcttcacgtgttttaagccagctacagcgcctgcgcttaaatccttgccttccatgatggaagcgtccaactcaaaagttccctccaccgtacaggtagcaccaattccggcgttaaacaacggatttccctcgaagtaattgattacggccatcaccgcttccggcccctcgcctcccgcagaaaggaccttatctccaatcattaaagcggagtccaatgcggcgtaatattgagccgacttaaccggatcttcctccaatccggccatcgcccccgcaccaccatgtaccacgattacatactcccggtcttgcgcaaaagcaatggatgacaccatcaaagccgtcaaggctatcatttgttttaacatgctattatatttaatcatttatacaatgctcaaaaatagaacaaatatctgaattatcttagagacatagacttatttcccgatttttatccgtacatttacctcgaacggtaatctcttaaataataacattatggaagaatacatcgattctatcataagagtgggaaagatattgatcggaagcataatggtcgtgttcgtactctggtacatcgtaaaggatattgtcaaggcttatgggaaagattcgcatgaaccggattaaaaaaagtgccgtggcgatatgaccacggcacttctcttcattatatcatagagagctatttcattcgttcgtataccataccggtcccggctggctgcccatgacgaactccaatgtcgccccgctcatgatttgctcgtgggtgatataactcttatcataaggttgtccgttcagcttcacggattggatataaatattctccgcagagacctcgggagccaaaaccgtaaagatcttgccattgcctacatgcatcttcacctccgggaacaacggggaaccgatctcatattggccgctgatcggatcaaccggatagaatcccatggcgctgaacacaaaccaagcggacatctgcccacagtcctcattaccgcaaataccgtccggagcattcagatacaagtcatgtaatacctgagccacgtatttctgggtcttccaaggctggccgaccttattatataagtagatcacatgatggctcggctcatttccatgcgcatattgaccaatcatgcctgtactaaagataggcaattcctcatccgatttggggacataggtaaacatactatccaatttctcggcgaaacgttccttacttcctaccaatccgatcaaaccgtccagatcttgcggcacggaccagaaatattgccaaccattgctctcgcaaatatcttccgtataatcatcggggctgaaattagcggcaaagtttcctttctcatcacgaggctgcataaaggaagttgccggattgtacacattatgataattctgtgaacgtttaaagaattcgtcggcgatctctttcttacccatcttctcagccatcttagcgatgcaataatcatcgtaggcatactccaaggtcttcgataaagaccagttctcccattttttcggatcgctataagccggtacgtagcccaacttcttataatcgccgataccccgatagtcatcccggttggctgtcgctatacaagcctccagcgctttctcggcattgaaatcaccgatacctttcagataagcgtctacgataacgggcaccgcatgataaccgatcatcatattcgtttcccagccataaaggttccataaaggcaaagccccgttctgctcatagaacttcaagaaacccttgatcatatcattcgcccgttccggctccgtatacgtaaacaacggatgggaggcacggtaggtatcccataaagagaaagtagagtaattcgtccatccgtccgctttatggatttgctgatccgggccgtaataagaaccatccacgtcgctatagatcgtcggggcgatcatggaatgatacaaggccgtatagaatttcaccatatcgtctgtattccggctcttcacctcaatcttggaaagctgtcggttccaattcgcgctagcctgcgcttgatagtaatcgaaatcatccttcggggcttccgcacgcaaattctttcccgctccctccatgctgacgccagagattccggtcgtgacaaggatttcctcatccttcttcgtattgaaatcgaaacgggccacataggccgtaccgatccaacctttttccttggtcacgatagaagtcgtatccatatgacaagccacgaaaggcttagagaaacgggtctcgaaataaacatgctgcaagggagaccagccttgggataggcggtatccacgaatcgtcgtagagtctaccacctcgatcttggaatccaaggtaaagtcccaattcatcgccttcttcaagttcaagaataccgaagcctcggcctccgggaaggtataccgctggataccgcaacgctcggtagccgtaagctccacgttaatgttataatccttcagcaatacccggtaatatcctgcggaagccgcctcgtcattatgcgagaacgtggaatagattcctaacggcgccggggcctctttataaggacgggtcacgggcataaaagagatatcgtataaatcgcctgcccccgtaccggaaaggtgcgtatggctaaagccggcgatcgtcgtatccggatagaaataccccgagatgcgatcccaacccggcaaaccgttatccgggctcaattgtaccataccaaaaggaacttgggctcccgggtaggtattgccggtaaaatccgtaccgatcatggggttcacatactgcgagtaatccgcctcctgtttcttttcaggcgtgcaggccacgagtgccagcaaagagaccgccaatatagacatgtgcttcatgttatgcaattcgttttgagtttgagcaaacatacataaattatttcgaaagagaaacagtttacggggaaaactttctattttcatcggggtgaaaatcttttttcattatgatgagaatctattttcatcaaggagaaaatcttttttcatcaagacgagaattcggtggaatcctttaactttgtacaaaaactacgataacatggaagataaaacatcgacacttcgtttgatctatccccaatggcaaggtgggatcgtgaatcattggatgcccgaccttcctgcggacgacgcttccagagggtattacctaggagctcaattactcaatatcctcgctcccccaagtccccagaaaaccgtggaagtacccatctcactagatataaacgatagagaaacggatctagggatcagcgcccgcaaggttattctgaaacaaacaaaagcagccctcgaattactgcacgaaaacgctccagaaaagattgtcaccttagggggcgaatgttcggtaagtgtcgtacccttcacctatctggctgctaaatatccggatgatatagccattgtctggatagacgcacatccggatataaacttgccgtatgacgagtataagggatatcatgcgatggcccttacggcctgtctagggatgggtgatgaagagattcttcaattattaccgggaaagttcaaggtctcgaataccttaatcgtaggtttacgctcgtgggatgagggcatgaaagaacggcagaagaacttaggtataaaaggtttatcaccagaggaggtggcgaaggatagttcctccatcctcaagtggttaaaagggacgggcgcatccaaagttgtcgttcacttcgatatggacgtaatcgatccggcggatatgatagcgggagtcggcgtagagcctaacgggatgaaaatagacgaggtcgtacgtgttatcaacaatatagcatccaagtatgatctggtaggtcttacggtagccgagccgatgcctcgtatagccatcaagctaaggaatatgctggaccggttacctttattgaaataataaaaaaagacgtagcccttaaacagagttacgtcttttttatattacattattataactttcgggatttattcctcattattatcttcctcattctcctcgtcttcttcctttggggcttttttcacgaagaacgcactcaactcatacaaaccgtagagcggtaagaatacgatacttaacgtaaacggatcactacttggagtgatgaacgccgcaccaactaacaagccgacaacagcatgccgtctgtatttatgaaagaacgagcggtttagcagccctatctgagataatagccaagataccaatggcatctcaaatacgattcccatcacgaatatcaacatcaagaagttatccatgtaagaatcaagggatacctgttccgtaatggcggcactcaactcgtaagtcgccaagaaacgtagtgtcatcgggaacaccaagaaataacccactgagcatccgataaagaacattatcgttccgaacaagaatacccaacgtacatttttcttctcattttcgtaaagagccggacttacgaacttccagatctcccacatcaaataggggaaagtcaataataacgccaaccagaaagaacttgtcatatgcgtgaagaactgggaagccagcttgatattgacaatgttcacatggaaagtatcattacaaaagtccgggagaaaagaaaaatgagaactaatcttacacatttcccgatagacgatgaaatcggagctacacggggccatcacgacattatcgaacagccacggcattaccgagaacccggctatagcaaaaacaaagagcgctaaaatagaacgaaataaagtccaacgaagttcttctaggtgatcccagaatgacatttcttcttgttgcatcttcctttacttcttttccgtatcgtctaatttgatatcgtcttccaatccttttacaccgtccttgaaattcttcacgcccttaccgatacctttcatcagctcaggaattttcttaccaccgaaaagcaataacacaacaatggcgatgatcacgatctcgcctgtacctaagtttcctaaaaatagtaattcattcatgatattataatattagtcattaatattctcgtttctatgggggcaaagatacaatttgtaatgaatagtagcctcattattccaaatttattacctttgcaccgtcttaaaaaactgaaattagaaaaaaattagaaagatgaaagcgtacgtatttcccggtcagggggcacagttcgtaggtatgggcaaagacctctacgataataatcctcttgctaaagagatgtttgagaaggctaacgagatccttggtttccgtatcacggatttaatgtttgccggaacagacgaggatctgagacaaaccaaagttactcaaccagcgatcttcttacactctgtcattctcgcgaaaacattaggtgatcaattccaaccggatatgaccgcaggtcactcattaggagaattctctgccttggtagctgccggagcattgtctttcgaggacggcttggtattagtttccaaacgtgccatggctatgcaaaaggcttgcgaggcaactccctctacaatggccgccgtattagccttgccggatgcgacggttgaggaaatttgcgcgagcatcaaggacgaggtagtggtttgcgctaactataattgcccgggccaattggtaatctccggctctatccccggtatcgatcaggcttgcgagaagttattggccgcaggcgctaagcgtgccttgaagttgaaagtaggtggagcgttccattctccattgatggaaccagctcgtactgagttggctgccgctatcgaggctacgacgatcaataaaccttcttgcccggtttaccagaacgtaagcacgaaagccgagacttgcccggaaacaattaagactaacttgatcgcacagttaaccgccccggtacgttggacccaaagcgtacagaacatgatcgccgacggtgccactcatttcatcgagttaggcccgggtgccgttcttcagggattagttaaaaagatcaataaggaaatgactacggaaggtatgcaataatttatctttcaatgtaataggataaaagtccgaaaaggatggagggtgattttcctcgtcttttccggacttttttatatacgatgatgattcgaaaagatcttgaatgctaaactaatcaaaggccaacgttgttttatactataaacacaattcagaatatagaaaatggaaacaatacaacagaaaaataggattatcctactttggccggatggagcgcccactagtaatggattggccggcgtagaattggaagatgccccgaatgccatatccaatatatcgaacccttccctattggtttatccggcgacgaagccgaatggcaaggcgatcttgatgtgtccgggtggcggactttccaagatttcgatcggacatgaggggcgtgatatggccgcatggtttaacgcgcaaggtattacttatgccgtattgaaataccggatgccgaacggacatagggaagttcctctggacgatgttcgccaaggtctccgcatcctccataattactcggaagagtggaagattacgaaggtcggtgtcatgggtgcctccattggcggttatatcgccgggcatgccgcaatattcggggtagacgacgcacgtccagatttccaaatactcctttatccggttatcagtatgctacctcatttaacgcaccttaaatcgagggaacggctattaggagcgaatcccacgcatgaggaagaggaagctttctctctggaattgcacgtaaacgcactgacacctcccgcctttatagcgttggcttcggatgacgaggcggttagcccggagaatagcgtgctttattatctcgctttgctaaaaaacaaggtgtccgcctccttacatatttacccaaaaggcggccatagttttgggttccgggacaacttcgtatacaaacgtcaatggactgacgaactggagaaatggctaagcacgattgagtaaatctcaaaaaaacggtgccacacaaataaatgcgtgacaccgaaaaagtatatataaaacagaccaagcaggttcgctatttagcgttccaccaaagtggagtagtcgtcaagtccgggccgcccaaaagctggagagcttgcgcataacccgcttgattattcgtttggatattcgccggataacgataacgtttcgggtagaaatcccaacggcattccttagaggtagcgaccgtcaaaggaacttgattcaatgggttgtaatccttctctaccgcttggttctcgaagaaaggaagacctaaacgacgatgatcgctccaagcctcttccggcaaccaaggaacttgcgctatatatttctgggtgataatcttcgtaagggcgtcattattataagcgccattccgatagatcgagttatggggatattcatacgtacggctttttacctccttcgtataggggtccgtataacggatcgtatatgatttcgcctctgtcgtatggtcgaaagcgacggaagtacctacacggttgtatttctgagacgataggtaatcaccgacttggctcaataagccatgatactcaaaactagccgtaacaccagactcataattggatttagccgttcccggaactttccagcctttcaccgcagcctccgccaataagaagtaactttcccacgggccgaagaagacacgcttattggtgctcattcgatattgtttcgatatagagggataattataattcttacctgtcagctcacttaccagaccggctttcacgtcccattctccggcgacccaagtgccccacgtatatttcggatcgatcgtcaacatattctgggtattatccgccggattcttcaagtgaaccggcttcacctcgctggccgcaccgatataatcggaataaaccacaccatcatcccagcccactacactaaacaacttcggggcacggggatctacatattgaggtataccgtcgaaatagaaaccggcgcacggatcattcgtcgtcagcgggaagtgctggttcaaatataaaccttgataatcgtatggattcttcaaatggctttttaaggagtccggcaacggaaattcctgtccacccaaaccaactaccaagttcttaaacgtcacggacatcgcctgcccattccaaggacgagacatcacgctcgtcagctcatcccaaccctctttctcctgcacggaagcgatatcggttggctcggaaataaatgtcttagaggcggcatcctcaaattccgctttcgctaaggcaggatcgacagccgagatacgcatcgccaaacgcatacgcaaggagttggcgtacttcttccatttcgcaacatttcccgcatagaaagcatcctcgttagccatagcggacatatccaaggaggggtccaacgcagactcagcttcccgtaactctttcaatataaattgatagatagcctctacactatcgtactcagccggtacaccggagaaagcggctaacgctgggatcggcccgaaaccgtcagcgacttccgagttcaagtaagcacgccagatacgggacatctggattacgttcttataatagggataggtatccgcctccccattggcaaccatccgctctcccagctggatcgctttggtcacttgattcagccaacctacggcgtaatcattactcaagtagatcgtactataatcattgttatccgtaccgatcgtaaaaccacttcccctattgaaacgggaagcacggtcccagtacaagataaagatacgctcggctatctctgggttcatctggtctcccatgatagaggcattcaggaaccattggggcttcaccttatcctctcccacaagattcgggtcctcattgatctcctgaaagtcattacaggaagaaagaagagcagccaccgataccaatccggtaaaaagtatatttcttgttttcatcttcatcatttttatcgtaattcaaattatcatgtattccattagaatcccacggttacgttaaacgtataggaacgactggtcggcgcagctccattctcgaatccggtagcgttggtattcgtggcggcaacagactcggggtcgatacccggcaagttataatggatcatccaaacattgttacaagtagcggatagacgtacacgctgaaaaggcgttttcttcaacatctgtcgattgaactcgtagccaaaggtgatattacgcaaacggacattggtggcgctataggtataaacctctggtaaaccataatttccggtagacccaatacgctcccaatagttctggggagtgacggcgaccgtattctccgcataaccactaccctgttgaaccacggtattcggtaccacgaattcggcacgatcaccattcaccactgttccggcggcgttaccccgggtatacaggttggaggctgtcgccgaatagatgctaccaccgatacggaagtctatcaagaagctcaggttaaaacctttataagagaaattattggtccaacccatcatccaatccggactctggtttcctactttcgacttctcggtagagatcaaaggcaaaccatcatcacctacgacgatctttccatagtgaggactattctcatcggtcacacgcataaaggtctgcccgtagatctcaccataataaccacctaccggagctacgatctggatagcgtcgaacgtctttatatcatatagattcacgccctcgtataattctttgatcttattccggttcaaggagaactgcgccgtagagctccagctcaatccggcgggattgtctagaatcgtaccgttcaaggagatctccaaaccctcgttctgaatgttacctgcgttaatcttacgggaagcatagccggagaacggatccatcggtaaatccagtaactggcgggtagcgttggatttataccaagcggcatccaagcccaatcggttattgaagaaacggatatcgaaaccggcctcccatgatttaatcaactcgctacgtacgtccgagtcgtaaagtaccttacccggtttcgccgtcgtattcccgttggggtccttgcctacagagtagaagttatataattgatacggatccaagtcgttacctacctcagcgaaggaggcacgtaccttagcgaaagagaaccaatccggcatgcttccgccaatcttcggcaacatatctgagatcacaagcgataaactgacagatggatagaaataagagcggttggctttcgacatcgtagacgaccaatcgttacgtgccgtaacatccaagaacagataaccatcccagttcaactgcaacgacccatacaaggaattcatacgacggcggatcaactcggaagtgactgtcggcttattcacgccattattcagcgagaacaagttcggcaccaacaactctccggcagaagcgttcatcttattacgctgctggagcatcaagttaccaccgaaagtaacgaagcctcccagccgatcgatcaagttatccttccgggccgtagccaagaaactgaagttattctcatagaaggtctccgatccctcggtatacagacctctcggactggtattaccaccggcatatactttctcgctcttcgtcgtggtataataatccgtaccacctctcaactcaatatcgaaccaatcggtcggggcatatttcaaggagatatttcctaacaaacggttacgggtatcctcgttctggcgataacgggtcacccaataagggttctcctgcggattcttggaggcgtcataccaaatcatattgccttgctcatccacgtcatcctcaaattcgcggatattcaaggaacgaggcaggttatagatcgtattgaaagcgttcgagggattcacgccctgaatcgggcggttatgcgcgttttgattgatataattcaccttggcatctactttccacttttccgcctcatccaagaaagtggtggcacgcaaggtaatattcgtcttgtttagttttgagcgtggggtgatactagcatcgtcggaacggtttacggaggcgaataccgccgtaccctttatgttctgctggaagctgacaccctcgttaaaggaggttccggtgcggaaaaaagcgtcgatattatcataagtatgcagagggatttggttgcctctccaatcggttaccatttgtcccatggctttcggtccccagctaaggcgggattggttatcgtaaacgcccacggagccttgtccgaagtcgttctgtaaatcaggtttcaggaaaatcgtctcggcggtgataccggcgttgatcgtaataccgagtccctcgttcttacgtccggacttggtagtgatcaagatcacgccgttaccggcacgtgagccataaagggcggcggcggaagcacccttcaataccgtcatggactcgatatcttccgggttgatatccgaaaggccgttacccatgtccgctccggagttaccccatacatcatccacgccaccggtgaagttatccatcggggtaccgtctacgacgatcaagggctggttgctacccgtcaaggagttgttaccacgaagtacgatcttagaagaccctcctacgccattgcttgaacggacgatctgcaaaccggaaaccttaccggaaagggagttcgccaagttcggctcacgggaggccaagaggtcatcccctttcaactcctgcatggcataacccaaggctttcttatcccgtttcatacccaaggcggtcaccaccacctcatcgagtttctgggtatcttccacgagtttaaccgtaatctcggactggccagtatacgggatgtcttgcgaggtataaccgataaacgatatctgtatgatatcccctttcttcacgttatccaaggtaaaatgtccgtccaagtcggtcatagtaccattggtagttcctttcacgattacggacgccccggtaacgggtcctaaggcatcctcaactattcccgacacctttgcgttttgctgtgaaatgtcaaccctcggaatcccggacataggcgtggcgtataagtttcccgagaacccaagcgcccctaccaacaggattaagctgactggtctgaatcttttcaacataactactgttttttgtttatttttctagacaatgttttagtttttgcgtcaacaaatgtcatttatcctgtataaacataaaaagggcagatatgttttgagtttaacatatacaagaggtaactggtgaggataccgcaactactctctccttacagacaaaacgaataagagttatccttactaacatccataaaaaattgatttacagaaattttaaccaaaccgtaaaagaggcaggaagccgttagttattcacttcagaagccaataaaagttccagtttacccatacaaatcatcaccacaaaaaaaagaaggcgtaccgacatttacatcgatacgcccttttctcgtaagaatattattctctataatttccgaatcagttacaatacaaagttgtcaaaagacaagaaaagacaagaagtagatatctttatttcctataaagtctaataagcatgaatagtaatcgtcagcacatcaccattcttgtctgtgacacaaaaaacagccgagtcccctttacttgcactctgtgtccaaattaacgcaaaacgtccagacccaccgggattaaattgaatatagtcacttccactcattttttgccacaagaaatctccagtagaaggttgagtaaaacgaatttccactgatttcccagcttcaataccaattgaattactagtcctaggttctccatccgcaaaaagcgctagattaccactgtcttttacataataaccatctatttgggcattgcaaaaaacactaattgttccaaataaaaacaataccattaataactttctcataactgtaaaatttaaaagtttaacattaaaaacataaatcctcacgttgaatgatgatacatcccaacgtgaggattcctattattttgcagtaaaaatactattcatattatttcatattccaccacaaagaagttgtcgtcatgttcggaccaccaagtctttctaaagcttggttatacccttccaagttattggtttgaagaactgccgggtaacgaagacgcttcgggtagaactctactttacattccttgcaagtagcaggagttaacaacacttggttagttggattgtaagcagcctctacagcttgattctcgaagaacggcaaacctaaacgacggtgatcagaccacacttccaaaggcaaccaaggattctgagcgatgaacttctgcgtaatgatcttagtcaatgcatcattattatactgaccattcttatagatcgtatttttaggatactcataagtcgttgtcttattctgtttcgtatatgcatcgtaatagttgatcgtataagccttagcctctaccgtatgatcgaaagctacagatgttcctacacggttataagccttagattgcaaatattctaagagtttatcggaaacaccgttatattcaaaactagcggcgatacctttctcataattatcctttgcgctacccggaacattccaaccataaaccgcagcttccgctaacaagaaataactttcccacgggccaaaccatacacgtttgttcgtgctatgacggaacttatcagccaaagaagggaagttgtagttataacttgtatagtcaccaactaaaccggccttatcgttccagtttccggcaacaacggtcgtccaagaatatttcatgggaagttttacttccggcgcggaaactttttgtccggtcagcacatccgtataatctcccgcaatcaatgttatctcatcctttacctcggaagcggcacctatataagaaggataaaccactccgtcatcataccccggaatgctatacaactgaggcgcacgaggatcgatatattgtgggataccatcgaaaaaatagcccgcacaaggatcatttgtggttgttgggaaatgcaggctgacattctggcctaagtaagtataaggatctttcaaattggatttcaactcatcaggaacaggaaattccacaccgcctagtcccactacgagattattgaaagtagtagacatcgcttggttattccaagttcttgtcatgacacctgtatacggatcccatccatctttctccgcaacctgggcgatatcatccatagaggcgataaactcacccttggcagcatcctcaaactcagcttgcgccaaagaaggattgaccgcagtcaaacgcatcgctagacgcatacgcaaagagtttccatactttttccatttctttatgtcaccaccaaaaaacggatcatatttggacatcgcactcatatcaatgctctcatccaaagaagcgaccgcctctttcaactctttcaatatataggtatagatatcctccaccttattatattctccaggaacaccggtaaaagcagataacgccggtatcgggccaaagttatcagacaattcagagttcaaataagctctccaaatacgagccatattcgggatattccgataataaggataggcattatccacatctaatttgattttctcctctccgacctctatcgcttgattcgccttattcaaccaacctacgccatacgagttcgaagtcaagtataatctattatagtcatcattatccgtaccgattgcgaaaccgctaccccgatcaaaacgagcagcccgcttccaatacaaaataaaaatacgttctgctatttcagggttcatttgagcatctccaatggagccattcaagaaccattccggttccacttgctccaaatcagccttattcgggtctttgttgatatcctcaaagtcattacaacttgtaaccgttgtcaatgaagcgaccgccaaggctcctaatataatgatatttttcgttttcatattatctcctttctattagaatcctacagttaaattaaatgtataagaacgatttgtaggcgcgccaccattctcgaatcctaccgcattcgtatttgtagctgccacagattcaggatcgatacccggcaaatgagaaacaatcatccatacgttattacaagtcgcggacagacgcaacttttggaacggggttttcttcaacaaattcttattgaacgtatatcctaaagtaatatttctcaaacggatattcgtagcgtcatacgtaaacacctccggcaaaccatagtttcctgaagaagcgatacgctcccaatatctttgaggcgtaacagcgacatcattcttcacatactcatcaccttttttcatgattgagtttggaaccacgaaatcagcacgatcaccattcacgaccgttccggcagcgttaccattcttatgcaaagaagaagtcgtcgccgagtaaatctcaccacctatacggaagtcgatcaagaaactcaaatcaaaacccttataagagaaattattcgtgagaccaagcatccaatccgggttctgattaccaatcaactctttatctgtcgtaatcaaaggaagaccatcttcacctaccacgacctgcccattgtggcgaacaaatttctgtccataaatatcaccatatttaccaccttcggtagcggcaatctgtaagacatccacagtcttgatatcatagacagtcaccccttcggttaattccaagatcttacttctattcaaagagaaatgagcttgcgcatcccagttaaacccactagcagtctgcataatagcaccattcaacgaaagttcgaaaccttggttctggatattacccgcattcacttttcgagattcatatccggaaaaagcatccatcggaatattcagcaactgattggtcgcatttgtcttataccaagcggcatcaataccaaaacggttattgaagaaacgtaagtcggcaccaacctcccaagacttgatcaactcactcttaaccgaagagtcaaacaaggtacttccggcagaagccatactattaccattagcatccttagaaattgtatatacattatataactgataaggatccaaatcattacctacctcagcgaaagaagcacgcaccttcgcgaaactaaaccaatcaggcatacttcctccgtttttctgtaccatatcagagattacagcagataagctaacagaaggatagaaataagaacgattctcttttgacatagtggatgaccagtcattacgtgccgtaacatccaagaacaaccaaccatcccagttcaactggagagatccgtacaaagagttcattttacgctgggtcaaagaagatgtaatagaaggtttatcaacaccattattgacatcaaacaaatcaggaaccaacaacgttcccgcacttgcattcattttggtacgtttctgctgcatgatgttaccaccaaatgtaacaaaaccacccaatttgctgatcaaatcatccttacgcaccgtagccaagaagctaaagttattctcatagaatgtctcagaaccttcagaatagctaccttccggcttcgtattacctcctgaatataacttttgagtagtcgtggtagtataatagtcagtacctcctctcagctcgatatcaaaccaatccgtaggagcatattttaaagaagcatttcctaaaatacgattacgcgtatcgtcgttctgacggtattgagttacccaataagggttctcctgtggactattacttttatcataccaaaccattttcccttgatcatccacacagttctcaaaatcaagaacattcaaagagcgaggcaaattataaacggttgaaaatgcgttggatgggtttataccaatgatcggacgattatgggcgttttggtttacatagttcaccttcgcatccaccttccatttcttagcctcatccaaaaatgaggtagcacgtaacgttaaattcgtcttattcagactttgctctggggttacacccgagtcatcttggcgattgaaagaaaagaacatagaggttccattcacatcttgctggaaacttacgccttcattgaaagaggtacctgtaccaaagaaagcgccaatattgtcataagcggccattggcacttgacgtccgtcatacgtagtaatagtctgtccttcaatcctcggaccccagctcagattggtttggtcattgtaagcaccaacagaaccctgtccgaaagaactttgcagttccggcaacataaaaggagtatccgccgtaactccaaagttcacattgatacccagaccatcattcttctttcctgatttcgtcgtaatcaagataacaccattaccggcacgagaaccgtaaagagcggcagcggaagcacctttcaatacagacatagactcgatgtcttctggattgatatccgaaagaccgttacccatatccgtaccggagttaccccaagcatcatctacaccaccggtgaagttatccatcggagtaccatctacaactaccaacggctgattagaaccggtcaaagagttcgcaccacgaagtacaatcttcgaagaaccgcctacactaccactagaacgaacgacctgcaaaccggaaaccttaccggacaacgcattggcgatattgctctcgcgagaatccagcaaagcgtctcccttcaactcttgcatcgcataacccaaggacttctcagatcgcttcatgcctaaggccgtaaccacgacctcatccaatttctgggtgtcttccgctaatttgataacgcctaccggttggccggtatacgtaatttccatggtggagtaaccaatgaatgagatttggattacatcaccattcttgacaccttccaaggtgaaattaccgtccatatcggtaatcgtaccattggtcgtgcctttcacgacaactgacgctccggtcactgggccgaaatcatcttccactgtacctgttactttcccgttttgctgggagatagaggtaccttgctcaacaggtgcgatgttggcatacatgcttcccgagaagcataacgcacccgcacatagaattaagctgacaggtttaaagtttttcaacataactgatggttttattgataaataattagacaatgtcttggcgaaacatttgtcttttaaaattattcacatacatacactcactcctgagttctagcgtaattaagttcaaataaaaaatgggctaactatcggagtcctacatgaacttttcttaagtagaagttgttttatttagttggcgccaaaatacctagcacattttatatcggaggcaaagatatgaaatattcattatattgtgttattataattaaataaatctttccttatttttatgttttacaatataaaattagaaatataaacggttttaagttaaaatcgacttgagttcatgtagaactaagtatctgcggtaagatatgaaatcacagtaattcaggcgttttttcagaatataaaagcaagccagcttcattagcaaagtaagttaattaaaatgccaaagtaagttaacttacttcgccgatgaagttaacttacttttattagatatcttctattgaaaaagaagtataatctctaaaaatctttctcattcgccatataccacatattaaggaacgaggccttcgtgatattcaccaccttgtcccaattaatccggtcggcatggtcgctcggttgatggtaatccggatgtccgtcggtatgataccagataatagggatacctatctttgcgaaggaaccgttatcactccctcctaccgggttatcccacggacgataatccggtgccagattcaagttgtatttcttgatatcgttcttcagccaatcgccgaaagcagggtgcgcctccgtatagaaataaaccacatgggtaggcttcgcctcgttattgttacggccgatcatatcgaaattcaaatatcctttcacgttctttatctctggaaaagactgaacgaaggctttcgatccgagaagccctttctcctcaccgtcccagaaagcgaatacaacggttcgctccggttgctggcccgtggcaaggaaagccctcgctatctgcaaaacggcagagactccggaggcgttatcgtccgccccgttatagatctggtcgccatccagcatcgggtcgatacccagatggtcatagtgagcgccgacaatcacgatctcgttcgggttcttcccctctatcttacccaatatattattcaaggatagcttctggaaaacaccggtctgcttgatagcggccaccgagtccgggtggacttgccaacgggctcctcttttctggcgttccagatggtaagcctcgaacggatggtaataggaatcgcccacgggatcgatacctaaggacttcaagttcgccacgatataatctcccgctatacggcctccacggaaaccggcctcacggccctccagatcatcatcggccaagaaaccgatatgcgcctcggcggtcgatctatttatcacgtccaaacctttcttctccggactttccgcccaaagagccgtacttaatgccagcgacattaagagtaatcctgcttttttcatcgcttttgtgttcaaatgattattgttttagctttttcattcacaaatataagtaatttccctgatacgcgaaggagaaggaaaggaaagggcacaaaaaaaggctcacccggccgtattgccaaaggtaatcctcatttcctatctctcaccattccgttttgaacggaggtaagagatgacatctaatttatttcttactttaattctttacttaaaaaagacgcagtcttttagttcttatccgcatctacactcatttcgctcataaggcgacggatctcagcgtttaatcgctgactcatggcaccattgccagctgactggtaacgatctgcttgataacgcaacatcgctaaagcacgaaggcttttctcattttctctcatcatcataatctttttgttttacgcttcccacgcttggaaagccagttaataaataatcctaaaacgatctttctttcttaattcgttacaaagataaccattttatccgaaacaatgttgtagaacataataaaatatttcattttttcgattatttatgaattgtgcaaataagtctaaatacgccggggattactccaccggcgttaattcacctgtaacagagtctattacaaaccctcttaccgttatatccgacggaatcagcggatgattccgaatttgctccacggtctcgtgcacggaagcctcggaggtctcgaatccccgcaaccacgactcgaagtttataccgcaatatcggatcatatctattcgttcctgcgggattccccgctctttcatcttttcgatcatctcggagctattcatgtgcttggctccacaatcggtatgcccgattatcattacctctacaaccccaagctcgtaaatcgccactatcaagctccggataacgcttccgaaggggtgggatatgatcgcccctgcgttctttataattttcacgtctccattcttgatgcccaaggaggcgggtagcaactcggtcagccgggtatccatgcaagacacgatggcgatcttcttatcgggatatttattcgtgatatacttctcataccccttgttctttacgaactcacgattatagcttaccaattcatcaatcatagcgtttgtgatttagcgttattaaactgtttatttatataacatcgaaatgtcttaaagcgttcatgacaccatcgtcatctacggagtcggtcacgtaatccgccgcctctttcacctcgtcgccggcgttacccatggctaccccgatcccggcgtggcgaagcatggccatatcgttgcctccatcgccaaaagccatcgtctcgtggagcgagatcccgtaatactcgatgatcttatcgatccctaccgccttactgctcccccgcggcacgacatccgcaaatagcgggttccagcgagtagcctcgcaatgcggcaagacggacatgatacgttcttcatggccgggagagaaaaaggctatcagctggtatacttccttacccccgttgccacgcaaaggacgcaagggaggatgagggaagtctagcatgtcgtaaagctgtcgcacagaatcatccacgtagttctggtaaatcccatcttcctccaccaaggcgcacgggaacgcctcctcattctcttgatagcggatcaacgcctctatatcccccgacgggatattatgtttatagataaccttatcttttccggccaagcaatatcctccgttcaaggtaacatagccatcgaactcttgcgtcccgaggttattgatagattgcaactggcggccggtagcgatgaaaaccttgattcccttttctcgcaacaggtccaaggcccggaccgtggagtccggtagtttatgcgtcttgaaacttaccaacgtaccgtcaatgtcaaaaaatactgccttaatcatacttatacctattatcttcttttaatgacaaagatacactttatttgttacatttgtattttcatttccttcatcaaataatagatatagttttttatggaatacagacaactaggaggttccggattatacgttccggcactttgtttaggtacggctacttttggtggcacgaatggttttgaaggttggggacataccaaggtggaagaggctacccgtatggtcaatctttgcttggacgccggggtgaatctattcgatacggcggatgtctactccaacggtctttccgaggaaatcttgggaaaggcgatccacggattgaggaatcgcctcttgatctccacgaaggcgactttcaacctcagcccggagagccgtaacgccatcggttcttcccgtttccatctgatacaggcgtgcgaggcgagcctgagacgattgaacacggatcatatcgacatttaccatatgcacggtttcgatgcgaataccccggtagaggagacactccgagccttggacgacttggtgacgagcgggaaggtccgttatatcgcttgctcgaacttctccggctggcacttaatgaagtcgctttccgtatcggagcggtatggatggagccggtacgtggcccaacaggtttattactccttgctgaaccgggagttcgagtgggaactgatgccgctaggcatcgaccagaaggtgggcgccattatctggagccccttatccgccggacgtctgggcgggaagtaccgccggaataacccgatcccgacggacgggcgtgtcgctcgcggaggaagcccgatacctgacgaggctacttcttacgaacgcctgtacgacatcgtggaggtattggaacaggtagccgaggagaccgggcatagcgtagcccaatgcgccttgaactggttattgcaacggcctacagtaagcagccttatcataggtgcccgcacggaagagcagctaaggcagaacctagaggccgtaggctggagcctcagcccggagcaggtgaagcgcctcgatatggcaagccagacgaccccgatctacccgtattggcatcaagcgcagttcccggaattgaattctcaattgaggttctagacggaggctagagaaagcgtatacacctcgggatgcggatagcacgaaagtccgcatcccctaaacacccattttcatccccttaaacgtatcttggttaagacgttttttatacttttgtaggctgttaccaactaaatctatcgtatgaggaaacattttctacttttcttgctttgtctagccacgaacgccagcctgacggcccaagagacccttcgggagaataacggggaacctacactcgtggaacgattatcgaacggagagatcaagatcaatagcgccgagatgaacttccagcttttcacctcggccaacgctgagtttgtcgggaacgagctagacggtatgaacttcaagctgaaccgtgtccggctggagatcaagggggacgtgggcaagtggctggggtatcattaccggcagtcgttcaacaaatactccgatccctattcgctcgacaacctctcctcctcgctcgagttggcgtacgtgaacctgaaggcacggcctaatctcaatttcacgatcggcaagcaattcgtcaatttcgggggatacgagtattacgtcaattccatccgggtacgagagtttagcgagttcaataatttactgaccgcctaccaagccggtatctcgggcaactggcaagtcaacccggaccacgagctttgtttccagatcgtgaataaccgcaacggtaacgatgaggacatctaccctaccggacttcccgagggtaccgccaaggccaagataccctttatgtacacggtcaactggaatagctattatctggacaagaccttgcaactgcgttatgccaccgccgtcggacagcagacccgcaagcgctattcctactatttcacctgtggcaacacctatgagaaaggcccgttgctaacgtacctcgacgttatgtacacccgccaagggatcgaccagcatggggtcgtcagccgtctgcccggaacgcctcataccgccatgaacaccgaatacctatcgattatcggcgacgtggattaccgtgtccacccccaatggaacgtttacgtgaaaggggcgtacgagaccgcccgggtgtataagagcaacggtgatttccggaaagggatgtaccgccgttcgtggaacgcgcagagtagcgtggaattcttccccttcaagcaactcgaccttttcgtattcgtcctatacacctaccggggcgttatcctagagaaagccgccacgcgaatgggagccatagagccggatacacaccgtatatcgctggggctggtctattcgatcccggtcttctgacaaaccgcgcatacggtagtacaagcttgtagatacgttagtacatacttgcagatacgttcgtgcaaacttgcagatacgttcgtgcaaacgtgtagatacgttagtacggatttgtagatacggtagcgcgggctgacacataaggaagtacaggccggcacatacggtagtacaggtccgtatcgccttatgtgcagcttcccccatccaccccataaaaaaagcggtgccttccgtttccggagacaccgccctcattctatactaaaagacctgttatattaagcctctacatcccaattctcggcagccatacgtttgtagctacgcagacgccatttagcgttctcctcggcggcggcaaacaactcagcggcctcagccggatattgtttagctacggaagcgaaacgaacctcacccttcaagaagtcttggaacttgctccaatccggctccttgctatccaaggtgaacggattcttgccctctgcctccaaagccgggttgtaacgccacaagtgccagtaaccgcatgctacggcttctttctcctcagcttgcgacttacccatacccttcttcaaaccgtggttgatacaaggagcgtaagcgatgatcaatgaaggaccgtcgtaagcctcggcctcgcggatcgccttcaatgtctgggcttggtcggcacccatagcgatctgagccacatatacgtaaccataagtagtagccatcaagccaaggtctttcttacgtaccctcttaccggaagcggcgaacttagcgatagcgcccaccggagtagccttcgaggactgaccacccgtgttagagtaaacctcggtatccaataccaagatatttacgttcttgccggaagcgatcacgtgatccaaaccaccgtaaccgatatcgtaagaagcgccgtcaccaccgataatccattgagaacgttttaccaagaagtgagacaattccttgatctgagcgcaaaccggacaaccctccttgatgccttgctcaacgaatgccatgatttgcggagccaattccttcgtcttctcagcgtcgttctggttagcgatccaagcggcggctatttccttggcctcagccggagcatgctcgcccacggtgatctgttgcaacaagccttccaaacgtttacgcatcttctcgttcgccaattccatacccaagccgaactcgcagaaatcctcgaacaaagagtttgcccaagcaggaccttgacccttctcgttcgttgtataaggagtggaaggaacagaaccggagtagatagaagaacatccggtagcgttagccaccatctcgcggtcgccgaacaactgggtgatcaacttcacgtacggagtctcgccacaaccggagcaagcgcctgagaattcaaacaacggagtagcgaactgtgagttcttcacgttagacttcacgtctaccaagttttgcttagaagaaacgttagctacgcagtagttccagttatcggcctcagccaactggccttccagcggaaccatagacaatgccttgttgcccttgaatcccggacagatatcggcgcagttaccgcaacccagacagtcgagaacgtctacctgcatacggaacttcatacctttcatagcggccggagccttcacgtccaacatagcgaagctggcgcccttctgctcctcatcgttcaatacgaacggacggatagaagcgtgaggacaaacgtaagcgcattggttacactggatacagttcgcctcattccaaaccggaacgaaagcggccacgccacgtttctcgtatttagcggttccttgcgcccaagtaccatcctcgatgcccttgaatgcggaaaccttcaataagtcgccatcctgagcgttgatcggacgaactacctcgttgatgaaagcgggatcgttgtttacgacagcctcatcatccggaaggttagcccaagcgggatcaaccgtcaattggttgtactcgccaccacggtctacagccgcgtagttcttgttaaccacgtcctcgcccttcttaccgtaagacttaacgatgaatttcttcatctgctcgatagccaagtctacagggataacacccgtgatacggaagaaagcggactggaggatcgtattggtacggttacctaaaccgatctccaaggcgatctgtgtagcgttgatataatatacagtgatattcttctgagcgaagtaacgttttaccttattaggcaagtgcttagccaactcctcggcgccccaaacggtattcaacaagaaggtaccgttctcacgcaaaccacgagtcacgtcgtacatgcgcaaataagcctgaacgtggcaagccacgaagttcggggtattcaccaaataagtagaacggatcggatgatcaccgaaacgtaagtgagaacaagtgaaaccgccggatttcttagagtcgtaagagaaataagcctgacagtatttatccgtgttatcaccgataatcttcaccgagttcttgttagcgcctaccgtaccgtcggcacccaaaccgtagaacttagcctcgaacataccctcaccgcccaaggcgatctcttccttctgaggcagagaagtgaaagtaacgtcatccacgataccgatcgtgaattggttcttcggcatcggcaacgccaagttctcgaatacggacaggatctgagccggagtcgtatccttagaacccagaccataacggccacctacgatcaccggagcatcctcctgaccatagaagcagtcttttacgtccagatacaacggctcaccgttagcacccggctctttcgtgcgatccaatacggcgatacgcttagcggtcttaggcacggcagccaagaaatgcttagcggagaacggacgatacaagtgaacggataccaaacctaccttctcgcccttagcgatcaagtgatcgatagcctcacgagcggcctccgtaacagaacccatggcgatgatcacacgctcagcgtcctcagctccgtaataatcgaacaaaccgtatttacggcctgtgatcttggaaacctcgttcatatattcctctacgatagcgggaactgcctcgtagtacgtgttggaagattctctgtgttggaagaaatgatccgggttctcggccataccgcgagcgaccggtctctccgggttcaaggcacgggcacggaactcggccaaggccttctggtcgataagcggagccaagtcctcattctccaaagcctcgatcttctggatctcgtgagaggtacggaaaccgtcgaagaagttcacgaacggcacacgagacttgatcgtagccaagtgagctacaccggccaagtccataacctcctgtacggaaccctcggccaacatggcgaaacctgtctgacgggcagacatcacgtcttgatggtcaccgaagatacacaacgcatgagaagccaatgtacgagcggatacgtggaaaacgcaaggaagcaattcaccggcgatcttgtacatattagggatcataagcaacaaaccttgagaagcagtgtaggttgttgtcaaggcacccgcttgcaatgaaccgtgaacagcacctgcggcaccaccctctgattgcatttcctgtaccattacagtctcgccgaaaatattcttacgttcggctgcagcccattcatctacatattcagccattgtagacgacggagtgatggggtaaatcgcagccacctcgctgaacatatacgagatatgagcagcggcctgattaccatcacaggttaaaaatttcttctgttttgtcatagacctataaaactattagtattaaaaaatatccttactcaatatagaaaaccgaacaaccaaagcgggatcatgttcccctccccgatctcggtcttatcaacagcatagtacatatccggattgttcttcactttcatgctttcctcgatccggaaattatacatcgtattcaccagaaagtgggcgttcttgtttccttcattcagcttattgtctttcagtagttggttataaaagaacgactcacgcaccgccccggcatttacctccatcggacggatggggtacatcaggttcgagttatacatatataccttggagggcttcttcggaaaggattcgcccaccggatacagcatattcatcaaacgagcatctgtcaaatacttgatatagttcatcacggtggcccgggatgtctcgatatccttgctcaactgactcacgtttggggtacaaggagcgctcgtagccaataagtagagtagtttgcgtagctttggtaggtagctttgttcgatttgttttatgtataacacgtccacctctagcatcatgttcatggtcttcagcagattctcggagaagttgcgcttttccaagaagaacggatagaaaccatgatggagataatcttggaaataagccatcggccttacgaccgagcaaatacgtttggcgatttcctgatgattctctactacctcatcgaacgtgtacgcggaaaactggttccccgacatcaagttcaagaactcacggaacgagaaccccctgaggttatacgataccaccttgccggacaagtccgggttctcctctttcagacgcatcaccgacgagccggagaaaacgatcttcaagtcctcgaaattatcatagcaataccgcaactctctcgaccagttggaatacttaaacacttggtctatcaacaacacctttccgcctttagcccgaaactcggcggcgaaatcaacgagtgtgcgttccgtaaaatagaaatgatttaaattaatgtataagcattccttattatcggcaccaaaatattcacgggcatagtctaacaagaaagtggtctttccgactcctcgcgaacctttaataccgatcaaccgatcctcccaattgatctcatccatcaatccccttcgtaccggagaatacagatgctctaccagatatttatgtgttttaaagaatgcttccacctacataattggtaattgaaaatttggaattaccgatgcaaagataaacatcttttctcatttgcaatgcggagattgcaattttattgcaaaaagtaaagttcaaactaacaattgcctatcaacgtattctgtctcgtaaagacggagcgcactccagtccttacgaaacaaaagatattattcaatgatcgagatccatccgtaagtatccggctcgtcgccatactggatggcacgtagcttatgatatagtttctcgcaaacaggacccggtttgccatctttggcgataacaaaagatttgttctcgtccaaatcgtcgatttgcgagatcggggcgataaccgcggcggtaccacactcggcagcctcgtcgaatgtagcgatctcctcgaaaggaaccggacgacgctctaccgtcaagcccatatcctcggccaattgctgcaagctcttgttcgtgatcgaaggcaagatcgagtgggattgcggagtgatatagctattgccacggattccgaagaagttagccggaccgcactcatccagatatttcttctctttcggatccagatacaatacggcggcgtatcccttggaatgagcgatctcgccggctaccaagctagcggcataattaccaccgaccttgatcgtacctgtcccgttaggagccgcacggtcgtactcacgaagtacgcataccttcgagggctggaatccacccttgaaatacggacctaccggagtgacaaatatcataaacatatattcgggagccggcttcacacccacctgagcgcccaagccgatcatcagcggacgaatatataaagcggcaccgctctcataaggaggaacgaaacgctcgttcaatttcacgaccttacgtacagcttcctcgaacatctctacaggcaactcagccatcttgataccccggctggaagattgcatacgtttagcgttctcatccatacggaatacacggatcttaccgtctttcccgcggaaggccttcaagccctcgaaagactcttgtccgtaatgcaagcaagtagcggccatgtgaatattgataatctcggatgaagaaacttccaactcaccccatttgccgtcacgatagtagcatcttacattgtagtctgtcttgatataaccaaatcccagctcagaccaatttaaattttccatatctatacaatttgctgtaattagtttaaaattaacaaattacactgttaataatatcgctcaaaagcaaaaacgcccatagccgtcgctatgggagattttgtgtaccgcaaatatacgctaatttatatatagttcggcctataaactaaaaaaagcaagcggaaggctacatttcggcctataacgaattataccaatctatcacttggtcgaactcattctccaactcttgcgctgggaaatcaagggcgaccggatagatcaaacacatccataaggaaggcgaatcggacaacttacggtaaaaagaaaccggtaaatccggtaaagtctccgtcggatcggtcatcaagacctcaaatatcagttgatagggatgcgagtaaatcacccggtaacggtgatggtattccggaccagtcaagaatgagtatcttggaatggggcgtatatcttgctttctatcctccggttccgttgtttccggatcgatctcatcttcttccaataaatattctacttggctatcctctgctcccgggaattctaagtctggagtctcttccatggcctcgatctccccaaaatccggaagttccgagaaatgtattcgttgaagccctgtatcctcctcggaaaaacagataatctccgggctgaaattccggttctgccgagaccacacctcataatccccgataaaatacacccgcttcttcgcccgggtaaccgccacgttcaggatattgctatttacccaacctatcgcaccagttgaagaaggttggcatcccaacaggaagataacctcctcggcttcttttccttggaatttatggaccgttccgcagttggcagtctcccaccccttaaatttacctttaagcccactatactcctccgtattcaagacggctttaaccgcagccttaatgcctttcacaaccgtggtgaagggggagatcacatataatttccgggtatcctctttctcccggtgttttcccatccacgccaatatcaagcgcaagcatacctcgccttgctccgccacgtaatgatcattattccctttagcgctagtacctttcttaccgggcacatcgatccataaggaatgatctagcaacaattgacttttctcctcgtctttcaccgcatctttcattcccagaatcatcgtatcgtcgtacgacacccggttggagatgctaaacataggattgatacaacgacggtgcacgaccaacggacagcctacccacgtctctccaatccaagacccataacggtttatcaaatcggcgaaaccttgcacggaatgggatttcgagaggtaagaagacaaggatacgataccacatttcttttgatagagagtcatcaacgtctcatcggtggtgactaccggttccacttgtttcgggtctcccacgatgatcgctttctttgcccgccacaaagcgcctaccgcacattggggagcggcttgcccggcctcgtccacgatcaacaatcccaattgctccctacccatgtactccagcatcttctgtacggaagcgaatgtggtagataccacaggcaccaagaaaaacaagctattcaacacatgtgagaatatcaattctttctcctccggcatatatttattatcccaaaaggccaacagcgaataaaggttgcaacgccatttgtaggaattgatcacaaaagagccatgcaggaccaaagcttgataaaatagttcttcccttgctttgtcgaattcagcgttcttcaaaggattcgaggactgcatcttctcgtccgccatcctaaatacctcttcgttacaagagaccgaccgccgcaatcgctccactattcgatattgcttcaagaactcttgttgagcgatatcgaaagaagggaaacggttcttaaactcccgcataaccttctcattgtctcttttaggactcatcttggaaacaaacggccttaataccatttcgctgaaagaacggatattatccccttttcctaaacgggcggatatcaatccccaggcctgtttcgtatgttttcccggatcggtatttccattgagcatattggaagccaaatctccgaaaaataaatctttaccctcactaaagactagagagtgcccggcttttgacatggcttcagcggtaggtagtttactcgtctcgggtaactcgaaggtgatattctctacagccgtattattacaggatgtcaccagaattccataatcggccaatccccgtcccgtctgcaaaccaaatgtcttctgacttttacctgcctccaaagacttcactaaaagcggagtctctgtaaaggcatcatccggctgattcaaatccgctaataaccgggcacgccgtaccacgtactcggcgataatatctttcagcaatgttgtcttacccgttcccggagggccattcacggagaaaatgccacagcctcccgcattttcttcggccaacgctatattaatagccatctgttgcatcaacgccgggctgaactcagaaggccaacggcccagcggatatctttccggacctaaccatttcctataattctctattgagcatatactttgacggttccctccactcatcaagggagcatttatatagttcaccagtaaacgattgggccttttatccagcagacttttacgaaccctgcttaaatctttcgcatagaagcttatgcttaagtccttatcatccgattttagcgcacgggcacaaacccgctccaaatcattccttctaaatccatcatttacggtaaatagactccggatccgcagtcgatctagcaactctaccgtcttctgccgcaaaagagagaagaactctatcccttcctcatcctcaattgtcataaagaagtcgtttccatcctccagtagttcctccaaccactcctcatcaacctcccggtcatgaattaagcagctgatcgcccagatataaggcgaaagttggaacgagccttctatgtactctccggacggggataaatcaatcgtatagagcacgcttacagatttattcttctccaacagcttacgaaaacgctcattatccttatccgccggaatcaaacgatatagctcggacaaaagatcatatttaggaacacctcccacatacagacggaagctatccgcatccctgtatggagcatatatgaaatacttcaactcatcctccgatctcacatatcttacccgtacctcatcctccggtaaaccagatttagaagcctgagggaatgacagctcttgaaaatattccaacacttcccagtaagccagaatactagttgttgtatcatgggtacgattcgagacaaagcccaatagcgtttttaagtaagttaagtccatgctttaaaaaaccttagtttacacgaaagcgctcagttagccgctttgttagattaatgatcgtaaatgtaagctatttcgaagtatatttgctacattcgcgtcaaaaataattaaaatatgaaagtcattgatctgataaggaatagtaagagtaccgctttttctttcgagatattaccgccgctgaaaggtaacagtatccagaaggtatataatgtgattgacaagttgaaggaattcgaccctaaatacataaatatcacctcccatcatagcgagttcgtctataaaaccttaccagacggaagtttccagaaagtaaacatccgtaaacgtccgggctccgtagcgatcgcttcggctatccagaataaatacggtattcctgccgtaccccatattatatgtaaaggctttacgaaagacgagacggaatacgctttgatcgatttgaacttccttggcgtaaacaacctcttaatattaaggggagatataaagaccttagaggcctcccagcaaaaaccggagttatatcacgaccacgcaactgatttacaacagcaggtaaatcatttcaacgaaggtattgcgttagacggttccaagatagacggtatagagactcccttctcgtacggcatggcttgctatccggagaaacacgaggaagcacccaatatggaatccgatatctattacttaaaggagaaagtaaaaaatggcgctgaatatctggtaacccagatgtttttcgataatgacaagtactatgcgttcgtggatcgttgccgtgcggaaggtatcacggttcccatcatccccggtatcaaaccgatcgttttcaagaaccaattaacggttcttccgaagatattccgtgcggatatcccagagcctttcgcgacagaattacgtaaatgtaaagatgatgcggaagcgaaagaggtgggtgtggaatggtgtatacagcagtgcaaggatctgatcgctcatggcgtaccgagcttacatttctacacaatgatggcctcggatagcgtttacaaaatagcaaaagaaatttattgagatacaataggggtttttccacgctgagttgtctaatagaagtacacgattgaacaatcatgtactaagtatggttatttttaaaattctaaggtaatgaaatacatattctttattggacttgacttgttattgtatccgtttttagttttactctatatatgtcaattgatatttacaaaaccccgcaccttttgatatctgaatacttttccgtaacttcgttccttattctatagaaaaggaaatatctcatgtattttaaagatatcatcgggcaagaggaagtaaaggaacggttgaggcaatcgactcggacagggatcgtaccccatgcgcagttattcacggagcaagggggggccggggcgtttccgctggctttggcttacgcccgttatctgaattgtacgaaccggacggagacggacgcttgcggacgttgcccgtcatgccttaaatatgacgaattggcacatcccgatttgcatttcgtattcccgatcgtagccaagaaagagaaaaagaaagaggtctgcgatgattatctcagtgaatggcgtgggttcctcaaagaacatccctatttcaatatggatgaatggctggattatatcgaggccggaaactcacaagcgatcatctattccaaggaaagcgatgagattatccataaactgagcctaaagatttatgaggcggaatatcgtatcctgatggtttggttgccggagaaactacatcctacttgcgccaacaagcttctgaaaatcatagaggagcctcctatgaaaacggttatccttatggtatccgagacaccggaccttatcctcgggaccatccaatcccgtgcgcaacgcatccacatccgtcccattgagaccgatgcgatcatgaatgccatggtatcccgtttcgggctttcgcccgacgacgctaaacacgtcgctcacctctcctccggaagttttatcaaggcgatggaggcgattagcttgggcgaggaaaataaattctttctggagcaattcaaggccatgatgcgaaactcatgggcacgaaacgtaaaaggcatgaaagcgatggcggacgtcatggcagggatcggacgggaacgacaaaaaaacttcctctcctattgtcagcatttgatccgggagaacttcatgtaccggttccaatcgccggaacttaattatatgaatctggacgaggctagcttctccgttaagttctcccctttcgtcaacgagcgaaacgtgatcgatttgatggaagaattggcgaaagcggaacgccatatcacacagaacgtgaatgccaagatggtcttttttgatttatccttacgaattaccgtactaatcaaaagataagtcttcagattttcttgttacgccaatttcctttccatagatagaagaaagaagaaaggatcatgatattatatacatactccgtagtccagcaaaccgccacgtccgcacgcaaccatacggcgacatacaatatatataatacgtacacgaatatgctagccatatcgatttccagcgcacggcgggtattgcctgtccccgatacgctaaagaaataaataaaaccgggaacggcgaaaagataagaggacagcatcacccacagcgaggggatcgagctagcgatcagatccgggttatccgtataaatacgcaatacggtagacgggaacatagcgatcaagataccgatcggtagcacgaacgcatagcatagcccgatcatcctccggcaaagcggaagcacccggtccgactccccggcgccgatcaagttacttaccagcgagctgttcgtggaggcgaaagcattcacgaacataaacaggaacgaggagatgctacgtaccacattcgtaatcgccaacggccgctcgcccagatgctccatagcgatgaagaagataaaccatcccccaaaagcgatcccatgctggatcatcacccagatagagacactcagtatttgtcccagcatcctaaaatccactctcgtaaaacggaacagaccatattttttataatctatcttcttccaagtataaatcacgaagaacaatacggaaacagcttccgagatcgaggaagcgatagcggcacccgctatccccaaagcggggaacccgaacttaccgaatatcaagatatagttcaagaccacgttggtaagcaccatcaccaccgaattggccgtcaagatcttcgtattcgtcgtactcacgtaaaacgcacggaacatcaccgctataaaagagaagaagaacccgtacacccgccagtccagatagctcatcgtcgcccgatacacctcttctgagccgatcatccggtggagcagatagggcgtaagcagattagaggccgtaaacaacaccgccgccagcagaaaaaggaatagcccgccttgcgtgaaaacctcgccgatccgcttatactccccctcaccattacgacgtgccatcagcacctgagctcctacactgaaaccaaagcccagcatataaatcacgagataatagactcctgccaaggcggaggcacctagctcaacctcgccgacacgtcccagataagcggtgtccgtcaatccgatcatatgctccatgagcaagctgattaataccggatacgtgatctttagaatttgtttgttcgtatatcgcatgatgaatcttaaataaaagggaggcaaaggtagtaataagatgccagtcacacaatattaccccatgcgatccgtttcttatcatattacattattatacgaagagatatggttacaaaactcatcatggcctgcattttgtccgctacgctattgagctgcaacgggcaaaacacaaatacgatcaactacgctaccgtcgaacccctgcatatcaatcgttttgacaaggatttattccggctgatcgatacgggagataccaccttgcaacccgaactaatcaaacaatacccggaaatgctggatatcatcgggaaaggcatattaaacctgcaaaccatcgagactcccggcttcttcgagaaaatgcggaattattactcggagcctaccttgaaaggcttgtatcgtgacgctatcacccaatatgattccgtggaggatatcgagaaatccttggggtacggattcgcctatctaaaggagaatttcccctcgatgcagatccctgctatctatatgcatgtatctggtttcaaccagaacgtattggtaggcgatagcctgctttccctttccatcgataagtatatgggaaaggactatcccttgtatcaggatttcttctatgactcccagaaattgaaaatgcaacgtggacttgtagtcccggattatctggcgggttggctcatgtccgaatatcctttcgcaggaaaagagaacgtattgctggaccggatgatttacgagggaaaaatcaaatacctgctctcgcaagccttaggcgttcccgatgccgccgagctaatgggatacaccgaacaggcctacaactggtgcaaggacaacgaaggaacaatctggaaagcaatcatcgagcgcaagcatctttataccccggatcaactgacgacttcccaatatttcgaggataccccgaccattttccccgggaacgacgctcccgggaatatcgggacttggataggctggcagatcatcaaccagtacataaaggagacgggatctaccccggaggcgttgatgcaaaacaacgacgcccaagaaatcctaaccgcctcaaagtacaaacccctataaacaggaaaaccgccctattctcacgaacaagacggataacctaatctaacttaattctaataccatgaaaaacactatatcttaataacaaggcttttaaaaaaaggttcaatggaatgagattttaaacctcttatttaccttggttgttgtaacaggaaacgaaaacaaggtgagtccgatggataatgatctcttagatataacaaaattgaggcgctggcggatctggaaattgaaacttattgacgccaggctttattttgtaagcattttcgtgggattgctgaccgggttggtagcggtaccttatcactatctgctccagcagttattcaatagccggaaactttttttcgacggtcattacccttggtatttccatgtcttgttcttcttcacgctatggggtatattgctttgtgtgaattggatggtcaagaagatgccgctgattaccggtgggggcattccccagacacgggcggttatcaatggcaggatcacttataagaacccgttgacacaattaatcgccaagttcacgggagggatattagcaatcagcgccggcctgtcccttggtcgtgaggggccgtgcgtacagatcggatcttacgtggggaatatcatttccaaatggggacacgtattggctggagagcgcaagcaacttttggccgccggcgcaggtgccggattggccgccgctttcgccgctcccctcgcttcctcacttttggtgatcgagtccatcgaacggttcgacgctcccaagaccgccattaccaccttgctggcaggggtcgtggcgggaggcgtagcgagcttgatttttcccttcaacccctactcgcagattagcgctattgccccgcaggctacttttatagatcaactgaagttgttcttatttctggccgtggttatttccgtcttcgggaaaatttactcgatgtttaccctttggtgcaaggatttctttaccagactgaagcatcctccttatatgaagatgttgtacctgcttatcatagcgtatacgatctcattgacggagatcgacttgacaggaggaggcgagcaattccttatcatgcaagcgatgcatggatatcaccccgttttatggatagcggcgatgatgctcatccacttgatattcacgtctctctctttctcctccggactgccgggagggaatttcatccctacactagttaccgggggattgttcgggcagatcatcgccttattattggtgaagtatggtttcattgagacggagagcatcagctatatcatgttaatcagcatggtaggtttcttggtggcggtagtccggacaccactgacgggtatcgtcttgattacggagataaccgggcatctggatgtattctacccctctatcattgtcggcgggcttacgtattacttcacggaaatgctacagataaagccctttaacgtggttctctatgacgagatgatctcgactccagccttccgtgccgaagggcgttccagcctgttcgtcgagatcatgacaggtgcctatttcgacgggaaggaggtagatcacctcaccctcccccaacgttgtatcatcaagactattcaccgggatcgcaaggacttggctcctgctggacagacccttatccccggcgatcaggtagagatcgagatcgattcgcaggatatcgagaagctgtatgagccgctggttagcatggcgaacatctattaatcgctgatctgccaatcgcctcgaaaagaaatgccacaccaagaatcccccggtgtggcacatttacaaaacgctacattatcagaagttatattgagcggaaacattaagtcgattggcgtggcgggtcatatcgttgaaatcggtacgccaacctctcaagtactcggcgccgacttgcagattggcgttcacgttccagaaaatgttggctaccaagtattgaccgtagcggtattgatccgacggagtaaccgggtaatcattctcgctgtataaacgagtctggctataggtactggagacgaataccttcggcgtgatattatactgcaagccagcataccaacccatcatcggaagcacttgcatcttgcctttggcctcggggtccggaaccagatccacgtccagattactgatatcattcaagaactggctgataccccggccgtaagtagcctgaccgtagaagttcagcttgctcgtcacattgaacgtagaggcggcaaacacgccccagccggccttagactcggcccgttgcgccaccaagttctcgtacgtcatattacgtacgataccagctacacggatatggctgctcttattccaagcgtattggatataggcagggaagttcggcatacgttggttactgatattcacgctttggttcgtgatgccatccaccactggcatctcgatacctacacccgctttccatcccttaccgaaagcacgctcatagcgtaacagggtggcacggctgaaaacctgtccggcaggccccgcataatcgatcgagggcggaagagcggccagatccatgaaggtactataatcgtaacccatcgtgaaaccaaggaaagacacataggcgttctggagctcgaagaccttgctgcctccccggaagttacccgccgtatacacgacgaaatccccgaggtgtttggtacgacccactaatttcaagaatatcgtactggtagtagcgtccatctggaactggttacggacgtagttctgcccaccattcgggatcatggacggataaaaatcgacatcatccgagatcccgccgaaatcatactccgccgtagccttcacgtaaccgccgatacccaaggcgaaacgtcccttacgatcggtcaatacgaagcggggggctttcgggtcgtggaaacgagggctctgcgtctcattcattatcctcacgatttcatcacctgccttgtcttggctgacaaggactatcgaatttggcgcatcatcctcgatgaccaccttttgagccttagcgggagccgataagaatcccatacctagcagtaatactgctccttgtacaaatagtctcataaatgtgttttgtttagattaattacctaccttgaacaaggctataaagaaaaggttctgattttaacaaccctacgagcactttttccaccctattgcccgttcaaaaaatattcatatatttgcggaatatattacttgggatgagaagatttttattgttcatactcgctgttctttacctcggggtttcctccgggtttgcgctgaattaccattattgtatgggtaagttggcggaggtgagtttgcagtatcttgacacttgccccagttgcggtgaggcgggcacgtcccataagtgctgctctaccgagacggaatatgttaagttatccgtcgatcaggatgtggcgaatacgctcgtgcaattgtccgctcctgtcgctgtagttttgttgttcgatctactcgactcctataagatcgccgggcgagacgagacaacacgttccaatccctttattaatccacccaaggagaatagcgctatcccgttattcgtccatcattgtacttttttgatttagcgtataggcttcctttttaaaaggcgatttacgtctgtttacgcacgagtaccggcgtaatctattgcgagtactggagtaatccaccgcaagtactggagtaatccattgcaaatactggagtaatccattgcgagtactggcgtaaagcatcacgagtactcatgtgatcgcttgccttcaaagacgaacaaataagcgttctcatatgttttcaaatcataaaagctcattcaaatgttaaatagaatcattcgttacttccttgagaacagggtggtaaccttacttttactagtgctgattatcgtatggggcatttccacgtcccccttcaattggcacggagggatcattccccggaatccgattccggtagacgccatccccgatatcggcgataaccagcagatcgtggccacggaatggatgggccgttcgccgaaggatatacaagaccagatcacctatccgctgaccacctctcttttaggtatcccgggagtgaagacgatccgtagttcctccatgttcgggatgtccttcatatacattatcttcgatgacgatatagagttctactggagccgttcccgtatattggagaagctgaactccctgcctccgggaaccttgccggaaggcgtacagcctaccttgggaccggacgctaccgccctcgggcagatctattggtatacgctggaaggacgggaccccaagaccggtaaacctaccggaggctggaacgccgaggagttgcgtacgatacaggatttctacgtcaagtacaccttatcctccgcagagggggtatccgaggttgcctcggcgggcggtttcgtgaaggagtaccagatcgagttgaacccggatgccatgtacgccttcaacgtctccgtgatggatatcatgagcgccatcaagaagagcaacctcgatatcggcgccgagacgatggagatcaataaggtggagtacctgatccggggcttggggtatatcaagaatgtaaaggatatagagaatgccgtcatcaccgttcgggaaagcgtgccggttcgcatatcggacgtggccttcgtgaatatcggtccgggaacccgacggggagggctggacaaggagggtgtggaggccgtgggcggagtggtcgtagcccgctatggctccaaccccttggaggttatcaataacgtaaaggcgaagatcaaggagatggaaccgggattaccccagaaggtactggcggacgggacggtctccaaggtaaccgtcgtgccgttctacgaccgtacggggcttatcaaggagacgatcgggacgttggagaccgccctctcccacgagatattgatctgcgtgatcgttatcatcgtgctggtgctcaacctaagggcctctatcgttatcgccagcatgctaccgatagcggtgctcgccacgttcatcatcatgcgttatacggggatagcggcgaatatcgtggctttatcgggtatagcaatcgccattggcgtgatggtggatgtaggggtcgtcttcgtggaaagtatcatccgttaccgggagatgcccgagaacaggcatatacaggggggaaaggcgtttgtcaaccttatttataaggcggtaagcgaggtgtccggggcgatcagcacggcgatgatcacgacgatcgtcagcttcctccccgtcttcaccatggaggcgcaggaagggaagatgttctcgcccttagcctacaccaagacgtatgctttggcttccgccttcgtgctgggattgatcttgcttccttccctatcgtattggttgttctcgataaagatccattcaaggctgatacggaaaatactgaattgcctgttgatcgtggccggaatcgccttacttattatttatggaagtattccggctatcgggctaacggcagtcggggtgaataatctattgtccggttattggaagaagcctcaaatgagcacttatatcaatatcggtatcaccctctttgtcacgatctattacctatccgaggaatggttgccgatggggccgcaaaaagggatgctcgccaatatcctgttcgtggcgggttgcgtagccatcatcctaagcatcctgtggctgctcgttatgtattatgagaggatattgcgctggtgcttggataaccgctggaaattcatgttgattccgggagctaccatcgtattcggtttctggatatggagaggcatcggacaggagtttatgcctagcctgaacgaaggttctttcctactgatgccgactagcatgccgcattccggtatcgagcaaaaccttgattatatagaggcgctcgacaaacggctggcctctatccccgaggtggagaccgccatcggtaaatggggccgtgtaaactccgccctcgatccagcgccggtacagatgttcgagaatatgatcaactaccgtccggaatgtatcctgaatgaggacgggaaaagggaacgtttcaaggtaaaccggcaaggggagtatctcctaaaagatggaggcgtatataaccccaaagacggtttccggctgattccctcagacagcctgatcccagacgctaaaggcgattacttccgccaatggcgaccggagatcaagaacacgaacgatatctggcaacagatcgtgaacgtcacccatcttccgggattgacttccgccccgaagctgcagcctatcgaggcccgtctcgtcatgttatccaccggtatgcgtgccccgatgggtatcaaggtgtatggcccggatctggagacgatcgagaaagccggaaaggcgatcgagaaggcattgaaagaggtaccctccgttatcccctcttccgtattttacgaccgtgcggtaggcgccccttatctggagatcgaactgaaccgtgagaatatggcccgttacggcgtaaacgtggaggacttgcaagagatattaagtgccgctgtcggtggcatggtactgacccgcactgtggaaggcagggaacgtttcccggtgcgcctacgctacgctcgtgagcttcgagataatccggaggcgctaggtatgatcctcgtaccgatcgccactggggcgcaagtcccgcttaaagagctagccgatatcaactatacccgtggagcgcagatgatccaaagcgagaacactttcttggtaggctacgtcatcttcgacaaactggcggggaaggcggaagtggatatcgtgaaagaggcttcccgcatccttgagcaacagataaaggagggcgagttgaaccttgatcccggcgtatcctataagttcgccggcaattacgagcagcaggagcgtgccaccagccggctgatgatcgtcgttcccctcgccttgttgatcgtcctgctggttctatactttcaattcaagacggtcactgcctcactgatccatttctccggggtgttcgtggccttcgccggaggttttatcttgctatggctttacggacaggattggttcatgaacttctccatcgccggagagaatatgcgggatcttttccagatgcacacgatcaatctgagcgtggcagtctgggtcggtttcatcgccttgttcggtgtggctacggatgatggggtattgatgggaacctacatccatcatgtattcctcgagcgagacccccgcaccaagcacgatatccgggaagcggtagtagccgccggactgaaacgggtacgcccagcggccatgactacagccactaccctgatcgctttgctccccgtacttacctctaccggtaagggggcggatatcatggtaccgatggctatccctacgttcggaggaatgctgatccagagtatgaccatgtttgtcgttcccgtcctgcaatgctggtggcgggagaacgctataaagaaagaacaaaagaataaaattcaagaggaggtaacgacttatgagatataaaagaatcagatcaatcatcatggcaggtgtactggggatgctaaacatccttttcgcttactcccagccggccgatagtttaggctattatctggaactggcggcacgtaacaatccgcagatcaacgccgacttctccctgtataaggcatctttggagaaagtctcgcaagccggagcctatccggacccggaactggagatcggtttcttcctgaaaccgatggagatcttgtccggaaagcaaatagcggatttcaccttgatgcaaatgttcccttggttcggtacccggaaggcggcccgcaacgaggcgaccgagatggcccggatggcttacgaacaattccgtaacagtcacaacaacctgtattacgaggtgaagagtcaatggtaccagctttgcaatatcagcgagcaatataaaaatacgcaggcgaaccttcgtctgctagaccagttggaacagttggcattgaaccgcttctccgctccgtcggcgaaggcgggcggttcctccgtcctaccctcccccgtatcttctgctccatcgactcctcccgccgtatccggtggaggtatgtcgggtatgggaggcagtagcatgggaagccctacggtacaaagcacgggagcatccggtagtacgatgtccggaatgtccggcggtagccctatgggtggaggctctatgggaagtggcaactctatgggcggaatgtcggacgtactgcgaatccagatggagaaggtagaactggagaatacgctagcctccttgttatcgcaacggaaaacggccgaggctgcttttaatacgttgctcaatcagtcgctagctaccccgatttccgtccccgactcgttggaacggcttcctctctcatggagtgagtcgatggctcttgacaacgtcatctccaacaaccccatgcttaccatgctggaggcggaaggaaacgcttaccgggccaaggcggagatggacaagaaaatgagttaccccatgctaggtatcggcctccagtattccttgatcgggaagaaaccagaggatatgtctatgggctctatgtccggtatgaacggaaaggatatgttcatgcccatgctaaagatcagccttcctatcttccgtaagaaatataacgcacagcaacgggaaagcaagcattattggaaatccagcgagttgaagtacgagaacacgatgaaccaactgcaagccgagtatatccgtattacccagcaattggaagatgccgcacggaaaatcgatttgtaccagaaacaatacgatctatcgttggccacctaccaactgatcgtccgggaattctcgacaggaagtacgaccttgaccgacgtgatccaagtggagcgacaaatgttgaactatcacttgaagaaaagcgaagcgatagcggaatataatacccaaatcgccggaatcgagaaattaatatccatctctgtaaacgaataagaaaatgaaaaatataaatgaaaccgtaaaatccaagtacctgatatatatcctgttcctagcgggcggcctcttgttgggctggctcctgttccataactccgataccgacagccatacgtcacaagcgagcgagaccggcacggaagttcacgaccctacgcatggccacgacctccaacagaacgaggccggcgagtggacttgttccatgcatccccaaattcgccaagacaagccgggtaaatgccctatctgcgccatggatttgatccctgtacgtaagagctccttctccgacaaggccatcgatcccaacgccattcagctttcggaagaagcagcagccttagcggacgtacaaacctccaaggtatcccgccagaatccggtcaagcaagtccgtttatacggcaagatcgtaccggacgagcgtagcctgcaatctcaaacagcccatgtaagcggacgcatcgagagcttgaacgttgatttcacgggtgagacggtgcgtgccggacagaccctcgctaccctctactccccagagcttttcaccgcccagcaagaattgttggaagcgatccgcatgggacaatctcaattgatacaggccgcccgtgaaaaactatatttatggaagatgacagatgcccagatcgccgctatcgagaagtccggctctatctccccggttgtagagatcaagtcgaacacgagcggtatcgtcctgtccaagcgggtaagccaaggtgattatgtatcccaaggagctatccttttcgacgtggcgaacctcacgaaggtatgggccttgttcgacgctttcgaggtggatctccctttccttagcaaaggtgatccggtggaatttaccctgcaagcgctacccggcaagaagttctcgggtaagatctctttcatcgacccgatcttgaacacgacgacccgtaccgccaaggtccgtgtagaggtaccgaacgcctctttggagctcaagcccgagatgtacgccacggcaaacgtaagcgccccgctccgcaactataagaacgagatcgtcgtaccgcaaaccgctgtgctctggacgggtaaacgtgctatcgtgtacgtaaagcaaccggatacgaatacccccgctttcttgatgcgtgaggtggagctaggcccttcccttggtaactcttatgttatcttgaatggcttgcgagaaggtgaggaaatcgtaaccaacggagtcttcgccatagacgccagcgcacagctggagggaaaaacttccatgatgaataacggcgacgagcccgccaagcctatgactgggcatgaggggcatatgatgcatgcgcaaagcgccacgggggtagcctccgagcatgccatgttcggtgtcaaaggctcttgcgatatgtgcaaggaacgtatcgagaaagcggcaaaaggggtaaatggtgtgttatccgctcattgggacaaagatacccagatgatccatctccagtacgatccccaaaagacctccacgaaagcgatcagcaaggcgatcgctaaagtaggccatgacacggatatggataaggcggataaagccgtatatgataagctaccggcttgttgccactatagataaagtattggacattcgggggtgtgtcaaaagtgtgaacatggcacgcagataacgctgattgagcagatgaccgcagatttatgatatgaaaatcaatatattatctgcgtaaatctgctaaatctgcgtgccataataccaacttttaacacaccctccttattagtaaagattccaacgaaaagaagcgactgctttagcgggaacctcgtaggtaaacgaacgttcgccgctgtttaccgttatatttttagtcccgtccgtattatttagtaatacgagcgcttccgttccatctaaattctcgaaggcggaatacataatcccatcagccgtataccctttagagccgatccgtactgcccccggtttcaccacagaggataaatgaccgataatataataatgagaattccgggtaatcgtcttataatccgagcgatcgatatccacagcaccataacaagtctggcaaccaccctctcggttcggtccccgctcgttgtccagcattaagttccatacgataactgccttacaccagttattcaccgtacccaaggccgtctcctccatatcttccatcaagcgtttctctaagttacgtccatcattccacatgccgatagaagtttccgtaaatattaattctttatcgggaaacttgccgtttacgttattcaactcttcccggtcgcccccgtaattatggtaagcggcacctgtcaggaaagaagcggcattctcatcctcgtagattttcatcggatagccttgctgctccaacatattatcgtaattgtaattatggtcgaatgcgtagatcttcgtcttgaggccagtctctttcagtttagggcctagagcgtcacgcacgaaagagagttgctcctcccatcccataaataaggaagcggaatttcctcggttcaaaggttcgttttggggagttatcgcctcgataggaatcccctcggcctccatcgcctgtatccatttcacgaaataggtagcgtaatcttgataataggcgggattcagctgtccgctagtccacgactcgaacggacgtaaatcctttaagttatccaccttcatccatcttggacaagtccaaggcgatcccaagatttttatagaagggctgatcgccaagatctccttcaagatcggtatcacatactccttctcctcgctctgcaaggcgaaattctcgacacccttcgtgtcacaacaagtatactcacttaaagaaaagtccgaacagccgatcgagatacggatatagctataccccatcccctccgtatcagagaaagtctctttcaggaaagctgtccgatcctcgggagccatccgcatcaagttatagcaggtagagcctgtcacggcggcgccaaagccatccatcgtctgatagcggaccgaagggtctatcgttatcacggaaggcgaggcggcttgtttgtcccccaaggcgatctcacttctcacgaaatctttcgcacgatcgtttgtcgtgacatacaccgttacattgtccgaggtcttcgctccagaacatgcgttcaagcaaatcaagaccattaataaagaaaagagaaccatacgtattaaattaaatagtttatcgaattaccgggtttctgaacctttcaagatcgccttcacgtgattctttaagatgtggaaggcaggagcggccatcgatccatgatcatatccgtccaactcatagatataagtattcttatgtccggccactttcatcatacgccaaaaataggcgttctcctcatagcggcccagcatctccatctcccggtcgcccgagacgataatcaatggaggagcgtcaggacgtacgtaaaacaaaggggcgaactcgtcgatactcggttgggtatctttcatccccttcgcctgccgataagcgaaatggctgatcgcatgaccgctgaaagggattaatgcggcgatggaatcagcatctatccggtacttagtcaaccacttcttatccagtccgaccatatttgttaaataacctccagcggaatgacctgagacaaagattttacgcctatccccaccatacttctcaatttcgctgaatgtccaagcgacagcggcggcggcgtcatcgatacaatcgctcaacgtggctttgggtagcagacggtaatttacggcgataacggctaatccgcggttcttcaattcctccgggatgaatttgctacctcccgacaagccgcctccgtgaaaccagactaccgtagggaagtcttttgcgttctcgggataataaagatccaatttacaacgttccaccgcatatggatttttcgattgggtataagagatatctctgactattttatagtcttgatcttgcgccgcaaggatattacagataaacagactaaatagaaataaatagattttcttcatgatattagataatagatttaatacatcaaatttaatataaaaaaaggagtcaccccttacggactgactcctctctcttccggctttcgcctttctcaagacggcggctacctactcttccactgttacgcagtaccatcggcgtgacgaggcttaacttctctgttcggaatgggaagaggtggatccctcgtgctatagccaccttaatatcattatcaagattttgaccggacatcaatccgaagagactcgcttcgccttatcgtcttaaaatatatcaaccttcactgtgaggaaagtcccgggctattagtaccactcggctcggacgtcgccgcccttacacctgtggcctatcaaggtcatcgtctataaccacccttgagggagatctaatcttgaggccggcttcgtacttagatgctttcagcacttatccgatccgtacttagatacccggcggtgcccctggcgggacaaccggtaaaccagtggtacgtccgacacggtcctctcgtactagtgtcagagcctcgcaaatctcctgcgcccacgatagatagagaccgaactgtctcacgacgttctgaacccagctcgcgtgccactttaatgggcgaacagcccaacccttgggaccttctccagccccaggatgtgacgagccgacatcgaggtgccaaaccattccgtcgatatgagctcttgggaatgatcagcctgttatccccggagtaccttttatcctttgagcgatggcccttccatgcggaaccaccggatcactatgctctagtttcctacctgatcgacttgtatgtctcccagtcaagcgcccttatgccattacactctgcgaccggttaccaatcggtctgagggcacctttagaagcctccgttacgcttttggaggcgaccaccccagtcaaactacccaccatacagtgtcctcctaactaggagttagaactcaaacaaccgaagggccgtatttcaacgtcggctccacaaatactggcgtacctgcttcaatgcctccggcctatcctacacatcgtctgcccaaactcaatgtaaagctatagtaaaggttcacggggtcttttcgtcccatcgcgggtaatcggcatcttcaccgatactacaatttcaccgagctcacggttgagacagtgtccagatcattacaccattcgtgcaggtcggaacttacccgacaaggaatttcgctaccttaggaccgttatagttacggccgccgtttaccggggcttcaattcaacgcttctcctcgcggatgacatctcctcttaaccttccggcaccgggcaggtgtcaggctgtatacatcatgtttccatttagcacagccatgtgtttttgttaaacagttgcctggacctattctctgcgcctcgccttacgacgaggaccctttatcccgaagttacagggtcaatttgcctagttccttaaccgtgaatcactcgagcgcctcagtattctcaacccgaccacgtgtgtccgtttacggtacgggtgccgcatggataagtttagcggattttctcgggagcatggttacgtccatattacgtcgcgcaagcgctccgtatactctcaggttcgactctccccgcggatttgcctacgggaatcaatatctacacccttcaaccggctattccgtcagccggcaggactgtcacttctccgtctccacgtcactccatgaggcagtatgggaatattaacccattcttccatcggcggcgccgttcggctttgccttaggtcccgactcaccctgatccgattagcgttgatcaggaaaccttggtctttcggcgggggggtttctcgccccccttatcgttactcatacctacatttgcttttccatgcgctccaacaagggtcatccctcatcttcgacgcggcatggaatgctcccctaccatgtcttgcgacatccacggcttcggcagatcgtttatgcccgattattatccacgccagatcgctcgactagtgagctgttacgcactctttaaatgaatggctgcttccaagccaacatcctagctgtctctgcgatccgacctcgttagttcaacttaacgatcatttgggggccttagccggtggtctggattcttctcctctcggacacggaccttagcacccgcgccctcactccctgtaaatatatatcgcgcattcggagtttatctggacttgataggcggtgaagccctcgcatccaatcagtcgctctacctcacgatatactataaagaggctgcacctaaatgcatttcggggagtacgagctatctccgagtttgattagcctttcacccctaccctcagctcattggaaagcttttcaacgcttacccatccggtcctccagttggtgttacccaaccttcaacctggccaagggtagatcactcggtttcgcgtctacccccccgacttggcgccctgttcagactcgctttcgcttcggctccgttcctcaagaacttaaccttgccggggaaggtaactcgtaggttcattatgcaaaaggcacgccgtcacgtcattacgacgctccgaccgcttgtaggcagacgggttcagggtctatttcactcccctgctcggggttcttttcacctttccctcacggtactggttcgctatcggtctctcgggagtatttagccttacgggatgggccccgctaattcacgcaagatttctcgtgccccgcgctactcaggatgccactaggcttcaatcgtcagtcgtgtacggggttttcaccctctatgaccgccttttccaaggcgttccacttgactctatcttgccacgtcgtggtcctacaacccccgtgtcgcctagacgacatgggtttgggctcttccgtgttcgctcgccactacttacggaatcattgtttattttctcctcctatgggtacttagatgtttcagttccccacgttcgcctcccttacgggatggcaggccttcagcctgccgggttgccccattcggatatcccgggatcaagggctatttgcgcctcccccgggcttttcgcagcttatcacgtccttcgtcgcctccgagagccaaggcatccaccgtctgcccttgcttactttctctcacctcgcacttgacgcacgggttgatatatcttaagctcgctctacttgtttcttctttttgatgtccaacatgtcaaagatcctctttccctcgcgggatgtgtggagaataacggattcgaaccgttgaccctctgcgtgcaaagcagatgctctagccagctgagctaatccccctcattcggagtagtcccaggcagagttgaactgccgacctctacattatcagtgtagcgctctaaccaactgagctataggactgtcaactttgccaagacttacgtcccagcgtcatttttttctctccgaccggcctcccggtctgtaagatctatatataaacataatctcaacagcagcacaagggatcaatacctcgtatgacctcggtacggaatcctaaagctccagaaaggaggtgttccagccgcaccttccggtacggctaccttgttacgacttagccccagtcaccagttttaccctaggccgatcctcgcggttacggacttcaggtacccccggctcccatggcttgacgggcggtgtgtacaaggcccgggaacgtattcaccgcgccatggctgatgcgcgattactagcgaatccagcttcacggagtcgggttgcagactccgatccgaactgagacgtggtttggggattcgctccctgtcgccaggtggcttccctttgtccacgccattgtaacacgtgtgtcgccccggatgtaagggccgtgctgatttgacgtcatccccgccttcctcgcagcttacgctggcagtcccaccagagtcctcagctttacctgttagtaactagtggcaagggttgcgctcgttatggcacttaagccgacacctcacggcacgagctgacgacaaccatgcagcacctcgcaaacggctattgctagaaaaggtgtttccacctcggtccgaatgcgttcaaacccgggtaaggttcctcgcgtatcatcgaattaaaccacatgttcctccgcttgtgcgggcccccgtcaattcctttgagtttcaccgttgccggcgtactccccaggtggatcacttaacgctttcgctgtgccgcttacagtgtatcgcaaacagctagtgatcatcgtttactgcgtggactaccagggtatctaatcctgtttgatccccacgctttcgtgcatcagcgtcagtaatggcttggcaggctgccttcgcaatcggggttctgcgtgatatctatgcatttcaccgctacaccacgcattccgcctgcctcaaacatactcaagcccccccagtttcaacggcaattctatggttgagccacagactttcaccgctgacttaaaaggccgcctacgcaccctttaaacccaataaatccggataacgctcggatcctccgtattaccgcggctgctggcacggagttagccgatccttattcataaggtacatacaaaacgggacacgtcccgcactttattcccttataaaagaggtttacgatccatagaaccttcatccctcacgcgacttggctggttcaggcttacgcccattgaccaatattcctcactgctgcctcccgtaggagtttggtccgtgtctcagtaccaatgtgggggaccttcctctcagaacccctatccatcgtcggtttggtgggccgttaccccgccaactgcctaatggaacgcatgcctatctatcagcgatgaatctttagcaaatattcccatgcgggatccctgcttcatgcggtattagtccgactttcgccgggttatccccctctgataggcaagttgcatacgcgttactcacccgtgcgccggtcgccacccggtattgctacctgtgctgcccctcgacttgcatgtgttaagcctgtcgctagcgttcatcctgagccaggatcaaactcttcgttgtttaaattgttttatcatatcctcgctccggaatccgtttatcgtagtccaaagtcatacttctattgatggtatcgatccggaaaatttcttttcctaatacttgtactacttgttgaattatgtaaatctctcaaagaactcttttgtcgctttcgttttgcgaacgtggatgcaaagataagtgtttttcttttaaacttccaaattatttcagaacttttttcaagaaaaatttgtttcattatttcggtatcgccgttctctctcgaatgcgggtgcaaaagtagtgctataaaacataacctccaaactttttcggcattatttttcaagttttttctcatggctcaacaatccttatttttaatgtacgcacacgataaaggcacatatatttatctgtactgatgttgacaatagctggatgggcatggaaataggtttcaagtttcaaggtttcacgaaccccttttcctcacacacgcacaagtacatataatacagttcctcatgatcgctccgtccgcctcgggtaaaaacatcatgtcgtggctacgcaagttcttcgaggctatccatcccgcataacaaacataaagggatttatttgaaacctatataatgtacgcatcgtgtgtgtgaagaaaaaggtttcatgaaaccttgaaacttgaaacctgcctatagtcattttttaattcgatacacgcataagcaaagaagagccatacgatagacttaataccttcgagccaatgacttaaatcaaagagcgcaaagagctaagtcatcaagcgcaaaggctcaacttctcatcccccaagttccaagtcctttatgcaccttaatccacaactaattaaaaaatctgataacagaacacgaatgtccgctctcatcagtccgacacattgaagcgtattcccacagggtcatcatattgtttttgcagcttataaagctcgtctcgcatgcgtttcgtcactgcctcgtaactgggcttaccgtaaaggttattcatctcgtggggatcttcttggaggtcgtaaagctcccatacgtcgatgtcgttgtagaaatggatcaatttataacgatcgtcacgtacgccgtaatgacgcttcacggaatgctcggcgggatactcgtagtaatgatagtaaagggagttacgccagttctccggccgctcgcctttcagcaagggaagcaaggactcgccttggatgtcggctgggatggggactccggccagttccaaaaaagtgggagcgtaatcaatattctgcacgagctgcgggatatcacccttcttgccacccggcagacgcatcagcaacggggtgcggaaggattcctcatacatgaagcgcttgtcgaaccagccatgctcgcccatgtagaagccttggtcggaggtgtagacgatcaacgtgttatccagcaaatcgttcttctccagataatcgagcacgataccgatgttccgatccacggaatggatcacccgaaggtaatcgtgcatataacgctggtatttccactcggccagctccttacccgtgcgtttcttcgccttgaagtcttggatgatcggatcgtaataggcgtcccaagcggctttctggtccggattcatgcggttataaagctcacggccgtacttctccagatcggcgttggaggaatggatctcgttctccttatcggccattttcaagtcgtatacgatatccatatccttgatgatgctcatctcctgctccgaggcggcgatgcggccggcgtaatcgtcgtagaagttctcgggcagcgggaaggtcacatcgtcgtaaagacgcaggtcgcaggtatcgggcatccaagtacggtgcggagccttatggtgcagcaggaggcagaaaggcttgctcttgtctcgtttattgtccagccaatcaagagccagatcggtcgtgatgttcgtggcgtacccttcgatctgacgcttctcgccgttatcgatgaagatggggttatagtaatcgccttggcctacgaggatgttccagtaatcgaaaccggtgggatcggaggtgaggtgccatttgccgatcatggcggtttggtaaccagctttacgcaatagcttcgggaaggtctgctgcgagccgtcgaaggtatgggcgttatcgatgaagccgttcttgtggctgtgcttgccggtcagcatgcaggcacggctggggccactgatggagttggctacgaagctattggtgaaacgtacgccctcgtttgcgatgcggtcgatgttgggggtttggatgtatcgcttgtcgtaggcgctgatggtttggaaggagtgatcgtccgtcatgatataaaggatattcatgggcttggcgggctgcccggacgtattctctttttggctacaggaggtggaggctatcgccgccagacctgccagaatgaatagtttatttgttttcatgtattccgcttagatttatgttgttttgattgattttgtctaaatacactcagctacagacttgtagagacggggcatgccccgtctctacaattggtgatattaaccttggtgatattagccgaggaggtctttcagcttgccttcggattgcagcttcacgatcaactcgccaaacagagtattcgtccaagcgaaccacgagcgggtgtaatcggaaggattgtccttatggaaagactcgtgcatgaagcccgtgcctccgtccgtatcacgaagcgtctctatgcaataccggatctccttctcgtcgttggaagtcgtagcacgcatgatcaagctcatcggccagatatagttgaaaccgatatgcggaccgccgatgccctcgccggcctttcccttgaagaagtaagggttggaagggctcagcaccaagcggcgggtattctggtaaatcgggtcgttcacgtccacgcaccccaagaacggcaaggccagcaagctcggaacgttagcgtcgtccatgaagacacggctgccgtaaccatctacctcgaaggcgtacaccttaccgaattccggatgctccacgatggcatatttcttcacggcctcctctacctcacccgccaacgcctcgcaacgaccggccaagtccgtgttatttcttacggcacgaagaatctcagccacctgacgaagcgaggtgatagcgaacaagttcgatggcaccaagaagccaaacagcgtagcgtcgtcggaaggacggaaagaggagacgatcaggcccaccggattcaccgggctaccccaaccatcgttcaagagggtatcgccttggcggtccgtcacacgggagaaacggtacggcccgaggctgtccttgcgctgttgctcacggaaagtacggtaaacggcctccatcgcctgctcccatttgctgtcgaatacggaggtatcgcctacttccttccaataatgatacgccaagcggatcgggtagcaaagcgagtcgatctcccatttacgctcgtgaagctctttcttcatctccgtgcggtcgctctcccactcgctcccggtagggccttcgttgaagccattagcgtagggatcgatcaggatgcaggcggtctggcgattgatagcaccaaccagcatctgccgcaagtccttatccttcttcgccaaggtgacgaaggggtaaacctgcgccgaggagtcacgcaaccacatggcgtgaatatctccggtgatcacgaacgtatccggcttgccgtctaccatcttgaactcacaggtcgtgtccaaggtattcgggtagcagttctcgaacatccaagccagtttcgggtccttgatacgggccttggaagccttcagttgctcctctaccgccttggaggtaaacttacgggcctcgggagccgggcgcttgctggcgtaatcgccggtcaccttagaggcgatcgtgctaaaactctttttattgtcgggcgtactcacggtggagtataccttctcgccaaccaacaggccggccaaggaaatagatcctgttttcaggaaattacgtcttgtagtcatttatatagtttttatggtattatattccagtggcaaagttaagaaaaaaaataaaggctcccaatccttttcggaccggagccttcgccaactcaataattccttaaattagcctaaatacgatttgaggagcttgctacgagttccttgtcttaatcttctgattgctttttccttgatctggcggacacgctctctagtgaggccaaatttgtcgccaatctcttccaatgtcatttcctgacagccaataccgaaaaacatcttgataatctcacattctctttcggtcagtgtagcaagcgctcgatcaatttccttagccaatgactcgttcattaacgaccggtccgcgataggagcgtcatcgttcacaagcacatccaaaaggctgttgtcttcgccttccacgaacggggcatccacggaaatatgacgtccggacaccttcaaggtatcggaaatcttatccaccgggatatccaactcatcagcaagttcctctggagacggtctacgctcgttttcctgctcgaacttggagaaggccttgctgatcttgttcagcgagcctacttggttcaacggaagacgcacgattcttgactgctctgccaaagcttgcagaatagattggcgaatccaccatacagcataggaaataaacttgaaacctctcgtctcatcgaatttctcagcagccttgatcaagcctaagttaccctcattaataaggtcgggcaaactcaaaccttggttctgatattgcttagccacagaaacgacgaaacggagattcgcacgggtcaatttctctaacgccctacggtctcctcttttgatagcctgtgccaattccacttcctcttctaccgtgataagatcttctcgaccaatctcttgaagatatttatccagcgaagcgctttcgcggttggtaatggactttgtgatctttaattgtctcattcaatttgtttaattgagaatacggggtgcaaagataaccatttttgttgaaagaattggctggatgcaccccacatccagccaattaaaaacctttaacaatcttttcacacctataagactacagtccttgtttatcttattcggcaagatctatcgcatagtacttcgtacgtccgttcgggtagaagcctttaatgaagaggccttgatcttccgtacgtccttgaagtatgctttccacaatcttttccaagtcttccggagcagagatcttctggttgtttacaatcatgataatgaagcctttctttataccggcgtctttcagcttgccgctggtcagaccggtgacctcgataccataacttacacctaacttacgtttctgctcgtcgttcaaagccttgaacgctgcgcccataacctctgcgctgtcgccacccttcacgaccttggtgctaccttgcgcattacggagttctaccgtgaatttcttcgtgctaccgttgcggttgatcgtcaactctaccttgtcgcccggacggtatttgctgatctgctcttgcaaagcgctagacgatttgatcttcacgccgttcacggctacaatcacgtcacccttctcgattccggcttccttagcggagctgcgctcggcgaaaccacctacgtaagcgccctcgaatactttcactttctctttctcagcgtcgggcacgtattgcgggtcttgtatcaatacgcctaatacggcacgctgcacggttccgaattgcttcaagtcgttagccaccttgccggcgatgctgatgggcacggcgaaagagtatccggcgaagttaccggtctcggagtagatagcggtattgataccgactaactcgcctttcgtgttcactagtgccccaccactgttacccgggttcacggcggcgtctgtctgtataaacgactcgatcttgctacgatccttgccaccggcgccgatgttgccacggctcttagcgctcacgatacctgctgtaacggtagaggtcaagttaaacgggttacctaccgccaacacccactcacctactttcaacttctcagaatcaccaaaggggatcgtaggtaagtcggttgcctcaatcttgatcaaggcgatatctgttgtcggatcagcccctataatctttgccgggaatttccggttatcgtttaaggtaacctccagctcgtcggctccgtcgatcacgtggttgttcgtgatgatataaccatccgtagagataatgacacccgagccagcgcccacacgaggttgctgttgcggacgttggaaccctccacggccaccgaagccgaagaaatactcgaacgggtccatatactgctgaccgccgtccccgttagaggcttgcgcgttagccgtggccttgatatggacaaccccgtggatggcgctctcggcggccgtagtgaaatcgatattctcggcggccacggttccataattcgtcaatcggtacggttgcttgaaggtattctcaactccggaggccaactccgccggacgttgattcttattcatcaggtaagtactcgttccgatcgcggcaccagaactaatggctgctatcagagcaacaccaagcacattcttccagatatttttcatacttttcttatttaattaaacacttaaatttaacagtttctttacggcaaagaaaactcaaaaattgtgcggatattccatttccatcgtattttttatcacttttaacgaggcatcacaggggcttaaccgcacttaacagtactgtgtattgcaaagtacctttttaacaattaaacagcagacgaattgacagttgacacgcgataactgacagtcggcaatcgataaatgacagtcggttactggcaatctagaatctctgttcgtataaaaaacacctaggagacagaatatgtttacggctgaaaaagaaaatgttatcctatctctcctatgcgtctacaaaataattgtcaaccgccgaccgtcaactgtcaactaaaatacctatctttgtcctatcgcagtctgctggtctgtcgctcaccttcgggtgtgaggaaagtccgggcaacacagagcaccatacttcttaacgggaagctgtccgtgagggtagagtaacgtaacagagaataaccgccggactcgtccggtaagggtgaaaaggtgaggtaagagctcaccgggtcccgtagcgatacgggatgccgtacgtcttatgggttgtaaggtcatgtataccggcgcatgtaggatggctcgtccgatgccggggggtagaccgctaaagcttaccggcgacggtaagacaagataaatggcaggcgcctctttccaaagaggtacaggacccggcttataggcagactgctttttttatttgccaattaaatcatgtgccgatatgcccaaaaacaagccacgggaagaaaagaaacctattggagaacggatcagcgcattattagcacgaaccatccgtttcgttacctacgacatttggcggattaccgagaatgaagttagtgggctgaaggagatttatatcaatatcatcaagacggtcatactcgccgtgcggggtttccagagcgagaacctgcaaaccaaggcgtcggcgcttacctacagcaccttgttatctatcgtacctttgctggccgtattattaggtatagctaagggcttcggtttccaagggacggtacggcaggagttgttcgattatttccccgggcacgagatggagctgaacaaggcgttcgagttcgtggagagctatctggcgcaggcgcaggggggagtgatcatcggggtcggtttgattttattgttttatacggtgatcaacttgatctcgtccgtggaggatacgttcaacgacatctggcagatccagaaatcccgtccgtggtaccggaagatatccgattatctggccttattcctcgtgctgccggtgctgatgacggcatccagcggtttgtccatcttcatgtctaccttgcagaactcgttcttggggcaatacttgttttttacgccactcgtagagctgttcttgcatatagcgccttatattatcacgacattggctttcacggggctgtacgtctccctgccgaatacgaaagtaaggttcgtgaacgggttggtggcaggctttatcgctggttgcgccttccagttgttccaatttatttatatcagtgggcagatttgggtgagcaagtacaacgctatttacggtagttttgccgcactgcctttgttgttgctttggttgcagctttcttggttgatttgcttgtttggcgcagagctgtcgtacgcctcccagaacgtgaagaaattcagctttgagagggacagcaaaagtatcagccgccggtacaaggatttcttgaccttgctgatcgcctcgctgatcgtcaaacggttcgtgaaaggcgagaaaccctatacggccgacgagctatccgacgcttaccgcatccctatccgcataacgacacagatcttatacctgctcacggagttgaacatcatcatcgaggtgaactacgggaatgacgaccgtgtggcatactaccagccggcgatcgatgtcaataagatcacggtcagctacctgctgacccgcatggacgagtatggctccgagaactttaagattgacacgagcaagcttttcagcaaggaatggaaagccctgctgaagacacgtgaggatatgataaaggcaaacgacaatatcctgctgaaagacctatagggaattgaaaattgagaattgagaattgagaattaatacaggaaatagggatttgacgagtggggcggtatggaaggtgatcctgcgtttcgctttccctttgctgatcggcaatctgctgcaacaactctataacgtgaccgacagcgtcatcgtcgggcagtttctggggaaagagtcgctggcggcggtatcggcttccttcttcatctattactttattatctcgctggtgatcggtatcgggagcggtacgtcggtggtgatctcacagtttttcggggcgaaggagttcgataaggtgcagaaggccttctcctctttctttatcttcatgttggtcgcaggggtattgctgtccatagcgggaattatttttgccgagccgatgttcaggctgacgaacacaccggaggacgtgatcccgcaggcggtcgcttattttaggatttatgtagggggtacgttcttgtttgtcactttcaatagcattatctccatattgcggggtgtcggggagtccgtgcgccccatgctgtttatcctgcttaccacgattttgaatatagccttggatttactcttcattgtcgttttcaaatgggggatcgaaggggcggcacgggctacggtgatcgcccaagggatcggcatgtgcgtggccctaggctacgtgaacaacacccatcccctgctctctatcaagaaacaggatttattgttcgatatgggactgttcaaggaagggctccgcatcgggcttccctccagcgtacagcaatgtgccatctcgctaggattgattgccttactggggatcgtgaacagtttcggcacggatacgctcaccgcttacggggcagcgggaaagatcgacacgatcatcatccaagcggtattgaccctctctggggcgctagctgctttctgcgggcaaaacatcggagctgggcacttggaccgggtacgtgacggggtacgattcgccatgcttgtcaacctattgctgggtctagcaaccttcacggccatctatttcttcggggacaagatgatgctggctttcaccaaggacccggaggtgatccggattggcaaggaatatttattgatcatgggaggattctttatcgtacacggcggcttgaacgtcttcaacggggcattacggggagctggcgataccctgttcccaatggcagtaagcatcacttgtctttggctgatacgcattcccctcgcctattggtttagctctatctggggacggagcggtatctggtgggccatcggcgccagcctttgcatcgggcttacaatcacctatatctattataaattgggattctggaagaacaaagggcctttacggaagaaataagcatagcttattattcgtttccatcggggtcgcatcgcccgatcgcttgattgaatagagaaaaagtcctcaagtcaatgacttgaggactttttagttgcggaggcaagactcgaacttacgacctttgggttatgagcccaacgagctaccactgctccactccgcgatatagtcgctatcatttcttgattgcgagtgcaaaggtatatattacattccaaacttccaaacattttcaagaaatattttcaatttgtttgcgtacacccttcgctatcgggcagtgaagccttgttaagcagcaatttgacactagaaattctcgatcgtatcaaaaccgaatggttcatataaatgcagacggtttctcaacgattgtatctccgcctgcaaattccgcatccggtccagcatatgatgaatggcctcgattccctcgatgttaatagacaagtcgtaatacatacgtgtgtattgttccagatcacggagctgggaagagaagagatacctctctccatccgtgatattaatgtctatcaaacctccctcttccagcaaaatgatgaacgaagggtctatatggcatttctggcagtattcactgacaataactaaatctgtttgcataatacacctgtttttaatttagactttgtatttcccggaacaaatccttctgtttctccgtcaagttggtcggcacctcgatcgagtacgtgacaatcaagtcaccaaactgcccctccttcttgtaaacagggaatcccttacctttcaaccggactttcgtattgttttgcgtgcccggttttactttcagtttcaccttgctatccaaggtatcgataatctgctcgccacccaagaccgccgtatagaggttcaaggggacggtcaggtacagatcgtctcccacccgtttgaaacggctgtcgtccggaataatgaacgtgatgtacaaatcaccggcaggtcctccattcatgcccggcccgccttggcctttcagcttaatggtttgcccgttggctacgccggcgggaaccgtgatacgcaggttcttgccgttcacggtgatcacctgcttatgtgtcttggccgcatccatcaaggataagtgcaattcggccgtgtaatcctgtccacggaacccatgattagaatggccaccgccaccccggcgggaaccaaacatagactcaaagaaatccgagaactctccatcatcgccggaggaggaccaatacgtacctccgccgttcgagaagccaccgccaaagccgccaccttgctggccatactgcttccgttgagcctcgaactcatccgcatgtttccaattctccccgtactggtcgtatttcttacgcttttccggatcgctaagcacctcgttcgcctcattgatctcctgaaacttacgatgggcgtcgggatcgttcggattcaagtcagggtgatattgccgagccaacttcttataggctttcttgatatcatcctgagaagcgtccttgttcacccccaaaatcttgtaataatcgatataggccataatctgatatgtttagtctatttttctcatataattatataacaataaacataccaaggatagttttggttagtgaaaatttacttaaaacgtttttaatcgtacacgcacggaattaagattgtccgtagatagaaaaggctctagccgggatcatcagataccgctaaagccttttatggataggaaattcttcgaaccttatttaaactgcatcatcttgctgatatacttcccgacaatatcgaactctaggttcactaccgtacctttctcgatctggcaaaagttcgtgttatcgtgcgtataagggatgatagcgacttggaaactgttttgctgggagttgcataccgtcagactgacgccgttcacgcaaacggagcctttctccacggtcatatacccctgctgggccatctccttatcaaaagcgtactcgaacgtatagtaccagctgccgtccgcctccttcacctccgcacaaacggcagtctggtccacgtgcccctgtacgatatgcccgtccagacggccgttcatcaacatgctacgctccaagttcaccttatcgcccactttcaggttcccgaggttcgaacgttccaaggtctccttgatagcggtaaccgtatacgtatcttccgtcatgcttaccaccgtaaggcaaacgccgttgtgagccacgctctgatctattttcagctcattcacgaatgagcacttcatcgtcagatgaaggtttcctttatcggattggagggctactacctgagccgcttcttctacaatacctgagaacataatcaaatcgtttttagtttgtactcccaaaactgttatttattcatgggcaaagataacgcctttgaggtaataagcccgataaaaaggaagttattaaatgtttttaatttacgatattatttatcgtccaaggagaccaaatcataccgctggcttcccatacccaacgcctccgcatgctcgacgatatggatgccatggcgggattccatgcgctcgatcaagtggacacggccagggtccggcgaggcgtaaaccagatctacgcaagccttatccaaggccacgggatcgagtgaggctagcataccgatatccgccattttcggctcttccgggttcgaatcgcaatcgcaatctacggagagtcgattcattacgctgatataaagtatattttcgccacaatgggtagtcacggccttagccgcctcggccattgattccaagaaatgatcctgttcgggaaggttgttccacaagtcggttttcgtcttacccgccgtatgtatccaagcctttccggcggatgaggctataccgatagagatatttttcagcgctcccccgaaaccgcccatggcatgtcccttgaaatgggaaaggacgaccgtaaaatcataatccagataatgggagcctacgaaatcctctttcaggtgtttaccgccttgaaccggaagagccacctcgccgtcggcatccatgatatccaccttagcgatggccgtgaagccatgatcggcggcggctttcaaatggctgtcggtatccgcgcgtccgcctccgtaagccgtgttacattccacgatcgtaccgtttactttctttaccaagtctttgataagtgtaggttgcaggaagttatggcctcccggctctccggtagagagcttcaccgccactttccccttggccttccgtcccaaggcgtcgtagagacggatcatgttctgaggagtgatatctttcaacatatataccttcgaaactccggcagaggattcgcttttcgcaatctccggcctcacttcgcctgcgatactctctacaggtatagaacctgccaccatccatgcgccacccataacgaccgaactccgtatgaagttacggcgtgacattttttgttttgctgtcatgatatagaatttaaattcatatgtttcttatttaatcgatacgcgaagttctttaaaaacttgaaaaataagactcctttacgaacaaaacgaattttgaaagcctaaaaacgaaatgggggttgttcacacggctccgtatcccgtatatcattctaaaacattccttaaagccacttgtttcataaatagattatcctaataatatagatcttatgaaatcaaagaatttaacactggcctctcttttcgccggcttgttcatgttcatgaaccctatgggaagcgaggcgtgtacaagggccgtttacctcgggccggacgatatggtcgtaaccggacgtaccatggattggaaagaggacccgcaatccaacctgtatctcttcccccggggcgtacagagaaggggagcgatatccgataataccatccaatggacctcgaaatacggaagcgtggtgaccgccgggtatgatatcggtacgtgcgacggcatgaacgagaagggacttgttgccaacctattgttcctcaccgagtcatcttatttccgaccggacgataaccgcccggttatggggcttagcatctggacgcagtatgtactcgataatttcgccacggtagatgaggcggttgccgagttaagcaaggaggtcttccgcatcgacgatccggatcttccgaacggggcgaaatcgaccttgcatctctcgatctcggacgcatcagggaatagcgctatcttcgagtacctaaatgggaacttggttatccatgagggacgggaatgccaagtcatgacgaattcccctacatacgataagcaactaaccttaaacgattactggcaacagataggcggcttggtcatgttgccgggtacgaaccgggcttccgatcgtttcgtgcgtgcctctttctatatccacgccatcccgcagacaagtaatttccgggaagcggtagccggggtattcagcgtaatgcgtaacgtatcggtacctctgggaatcacgaccccggatcaaccgaatatctcctctacccgctggcgtacggtagccgaccagaagaataaggtatattacttcgagtctactttaagcccggatatcttttgggtcgatttcaagagcttggacttcaaggcaggtacacctatcaagaaactaacgctcacaaacggcgagatttacgccggaaacaccgccaaagatttcaaggacagcaagccgttaccgttcttgttcgggatctgaaggactagaaaaacagacaagaataaataaggggaggtatcaaaagtcggtatttactccccccttatttttaaacaagcgttattaccttttatgatatgcttaacaattaaagcctatgcctaaagctatccaccggattcgatgtggcagcccggtagctctggaaaaagacagagacaaacgagatcatgaggcagaataagccggcggcgataaatatcagcggacttaaaccgatacgatacgaatagtcggacagccaatctttcataaagtacataataataggtatggcgatcacgaaagcaatcaacacatagttcaagaacgtgaatacgagcttaaccaatatctgccggttgctggaaccaaatacctttcgtacggatacttcttgcaaacgctgttggataaagtaagtggacatcgccaataagcctagcaaagaaataaggatggcgattatcgagaatacgatcacgatctttgccaaacggatttgcgagtcgaatgagttttgtaaacgctcatccatgaagtaagcctcaaactcaagtccggtcactttctcatatactttaccgatagcctcctttgcggcgaaaggatcaccttgtgtctcgatcaagatcatccaaggatcttcattatctttcaagaaacggaacatgacagggttcatccctgtcgtcacatttccaaagcaatagaaatcccggacgatacccgctatcgctatcggtctttcttgcctgtccagcataaaagaggccgcatcctccgataagttcatctcacgcatcgcttgctcgtttaggaaccagccctctgtcgttaaatggttatcacgcaaaatctccaatcccagcatatcgtaacactccttatccataacgaattgctgaaaagatatattttgcccctgataagtagcagtccaattattactaccgaataaaggcaatccttgagtcttcccgaccctatctacgcatgacaaacctttcaactcaccgacaaaagcggataactgcctttcatccaccgaccgcatagccaataaattcttcgttttatatccgacaggagcgttgatcatatgaacgatctgacaaaccatcgtgatagaggcggcgatcatcgtgatcgtgatcacattttggaatacgataaagaacttactgaataccattttcgtcttagcccggaacgtaccccttaccacctcgatcggtttagaagaagaaataatgatagcaggcagtaagccggataaaactcccacggcaaccgttaatgaaaccagagccaatagccagacaggtctacccaatacattcatatcgacacgtgtctgcaataaatcattgacaaacggcacgaccgccagcgcaaggagaaccccgataatcaaagaaataaacgtaagtaaagtggactccagcatcaaacgcatgaataactcaccccgtaaagatcccaaaaggcgccgggtagccatctccttcgccctgaaacccgcttgggcaaccgtcaagttaatataattgataaccgcaaaaatcaagataagaagacctacggacatcagcacgatcacgaaacgccaatctccctttcgcaaagaagagtaagaagcggctttcgcaaaatactgctcactaagcggcaatatgcgtacctcttttgccgtcccatattgatacggccaataaaattccttgaaccaatgggccatatcctccgcacgagaagggaaatcactaccctcacgcaccaagacaaaagccgatgtacttccggcattccccaattgatccggagccaacgaccagttcaaataccgaacctgctcccaacgcacgatcacatcggcttcgggaatagaggaatgaagtaaatcctccaccaccccgtttatagtagccgatatggtatcgcccaccaccaacttccgtcccatcggatcatccgttccgaacatcttacgggcgaacgaagaggagaccaccgcatagttcccggcggccaacgcttgctcacgagtgccttgtagcaaccggaaatcaaagaaatcgaagaacgtagagtctgcgaacatcacgtttgccttcagtttccgatcaccggaaactacaactatatcactcgaattacccgccactaccggacaaactttttctacctccggatagcgttcctttatcttataaggaatggcggctccggtggccatccaattttcattcccgaccagatagatacgatccgccttggtatggaatttatctgtagacatctcctgtaccgtatagaccgctatcaataacacaaacatcaacgatacagacagaccaaacacgtctatcagcgtataagccttattccttccgaggaacttgaaaaaggacttaaagttcaataaattattcatgaattataaattttcaattactcagatttcaagcagttcaccggattatcattagccgtcttgcgggcatccagacaaaccacggaatatataatcaataagacacatacgccgcaacccaagaatatgtaccatgacaaaggtactttctccgtgaattgctcttgccacttttgcaagacaaagtatgctatgccaccgcctaatatgaccgcatagatacagatatatccgatatcctttatgaacaacctcaatatatcccataaggtagccccattcacccggcggacggcgatctccttacgacgacggctcacctcatcattcgtatagcctataagtcctatcaacgtaacaagaagcgtgaccagacctccgatcatcacggaatcacggaattggcgggagtccttatatagatccatgatctcggaacggaaagagatagcgctcagttcacgatccggaaatgtctcggatatcttctgctgtaaacgagccatattatcgttggtcagctcatggaacttcacctgcaaggtgtacatgggcttatgcgcatagaataatacggagggccgcatatcttggttcgagattcctcccagacggatattctcatacacgccgcaaatcgtgaatggctcctcattccatttgctatgctcggtgacgcaaatatccttcccaacaacatcatccgtccagcccgctaccaatttcatcttctccacgaaacggcggtctaccatcacctctctcgagttggtcacattctccgtgaacgagcggccttggatcacgggaatctccatcatgtccagatatccgttgcctacccaatagagatcggcgatattaaaaagctcttgagtcccgcccggtaaaagaatattattaccggaagcatgctcgaaaggcaattgataaacggtggtagccgcagcgactcccggaagccgcatcacctcatccagaatcttggcacgagaggtagagtccacgccagctaacccgcagtaggcaaggttctcataggcatatcccggacgatcattcaccataaacgtatattgacgggcaacgaaaacaagcatcgtcaccaaaaagcccgtagcaacaaactggacaagcaacaaggctttcttccagatacgcttattctcccggtaattacggaaagcggaggccaccggaatccgggcgtataatgatcccggcataaaaccagatacgaaaaacaccaagatacatatccctagcaagaccaagctaccattagacaagagcaaggaatctaacgaagtcgccaacaactcctctaccgtacctctaaacgcaaggatcaacaataaggccaagatcagtgaaagcactatatgtaccaacgcctcaccaaacatcataccatgaatattattctcgcttgccccataacatttatggacagccacctccttcgagcgatttacgatagaggatatcacgatcaagatatagttcatcaccgccgtaaagatcaaagcgaaggccagtaaggaaagtatccacgtcattcgcttgacttgcggcaactccttgtgtagattatctagcttatgaaatgagaaatcaatgcttaacccgaccttttgctgttcctccggagggaaataagaattcacaaacgtacgcacctgttcctccaaagctaaaggattcacccccttgtgcaacttcacatagcttatgtaacgatcgtttcccaacatattagtaggcgaaccctcccacatgaaccgacccgccgaagccatggaaacaattacatcgtaacgggaatgagaattttccggaacttcctcaaaaacgccaccaatagtcatagtacgtcccggcgaattgtctaccgtgaagtttttcccgataacatcgcctccgatatttttcgctatacgacttgatatcaacacgtacatcggggtggaaagaacctctttcgcatttccgatcaacataggacgaggaagaatatcaaagaaacaactatccgctatgatacaacgaccggagtatttcatcttggtgtcggtcatcgtaaaggtccagtctccaaaactcgtgtatcgggtgacggtctcgatctcgggtatctgttgttgcatagttggagcgatgccaccgcttgtttgcggataatccttcaactcccctccattttgctggtatttcgcccagacttgatagacccggtctctatccggataaaaatcatcatacgattgttcgaaatagactttagcgatcaataccaagcctaccgctaagccgattcccaacgatacgattttcatcacgttatgccgccctttcttaaaaatggaacgaatggcgattagtatgtttttcatattatatcgattttattccagcaccagcacttcattatccttataactctcataactggacacaatcaccttctcaccggcttccagaccttcaagaacctcataatattgcgggttctgacggccgatcttgatagaacgcctgtaagctttctttccatccggatcaagaacaaatatccagcttccgcccgtgctctggaagaaagttcccttcgggataatgatactctcggtaggttgccccagctccaagttgatatagtaggtctgtccactacggatattatccggacgctcacccgtgaaaacgaaatccgtacggaacttaccatcacgaacctcgggataaactttgcgcaccgttaagtcgaaagacgagccttgacgctcgaaagcggcgcttaagcccggtttcacgcggtctatataatgctcgtcgatcatggcctctatcttataatcggaaaggtcgttaatctggccgatcttttgtccgggattgatgctttgccccaatacgacatccaacagtcccaactcaccgtcgatctgggaacggacattcaagttttccttacgttcgcggatcaacaggatattcttccgcatgttcgccaagctggcctccatctcatccatctggatcgtgcgggagatagagtcttggcgcaagcgctcggtaatcaaggcgtgcttttgagaggctaactcgaagtcctccttcgctttcagataatcctccttggcgatcaagttctctttatacaactgctcttgttggttgaacgagcggcgggcccggttcatgtccatatcgtattgaagtttctccatctgattggtcagcttatcctgctccatggtaacctgcgtattacgaaggaagttctgcttctccgccaactcggcctcagcgttcaagatctgcaaatctagatttgagttgctcagacgaacaatgatatcgcctttcttcacttgggcaccctcttccacgactttctcctgtacgataccgccctcctcggggctaagctgcacgaccgtgataggttgcacctgaccatccatacgaaagaagtcattgaattgctcacgggtcacattaccgatgctaatccctctcgcatccactttcaacgtagaagcatgatcaccaaagataatccatcccaacaagataacgaacaacacgccacccgctacataaggaatatgcttcttctgaagacctttctttttctctaattgtatatccatcgtattctatattttttattatcatctaaattctatgttctcaattcttattcattgataagaggcttgcccttataataatccaccagcttgcttttcaataagtacatcaatcgcttttgaagcagattggccttggactccaacagcgtattcgcacttgtctgtacatccagcgtgctcatcaggccttcctcgtacttccgtagggtaacacgataagccaactcatccgatttcaccttcttatccatctgtatggcctctttagcgtatccctcacgatccaagaccgattgctctaccgctgtctgcaactggcgaaagacctctgtccttgtctcccgtgcgatccgcatattgttacggtaacgacgagcgttcgttaatctgctcaaaccatcgaataaggggaagctaaggctaaaagagacatattcaccacggttatttttaaactgatccttgaaaccttccggggcattatcagacttcaggttctcgaaataactcgtagagattccggcattcaaataaatgctcggtagcaactttcctttataaatacgatattggtatttactttgcgttaattgatactcggcttgcaaggcggtagggttattcccggacgcataggcgaaaatctccgccacattctctacttccgggacataattgatatccggtaataaagtatccacctccagttctaaatcagatggataattcatacattccctcaaagtaagcaaggccgtattgaaaagattctgttggtgggtcaatgtataatcatcggctgccacctgagcctcgaattgagctacatccgctttccctttcaaacccagctcttcttgccggcgagtcttatataaggtacggttactctcctccaatttctcggccgccatacgaatcgttcctttataatacaccacatccatataagcctgcatggttttcatcgctaaatcatctttcgctttctgtatgtcattaactcccatacggcgattggattttgccatcaaccattgattgatcagctgtccgcccgtaaaaataggaatagaagcgtcgaggccatagttattattaaacgtagaagtattctcataggtattggtcgcagggtcgatcgaacggccaaaactatattgcgctccgaccttagccgatgccgccgggaaaaaagaagctacggcggcattccgttccgccttatacgtatctgatgtataaacttgctttttaaccgatgggctgttttccacggcatagcgcatacattcatccaaagtccaaagtttctcttgggccaccgtcgcggtagcgaaactgagagaaagaactgttgtaagtaatatttgtttcattgctctattattttctacctaaataatagcaaagaacgtgccaaaacacataaacaactaaacaacaatcagataacaaaaagctattcttttagaactgtccaatattttgacaacgctgtctaattgtttgacactattcccactttgacacgtaagagcgtctcctcttctccctaagtaaaaaacgctctactcctatatgaattcttgctcgatagcctatgaattcttatgcgcatactgtataattctacaaaccacgacgtggtctgtacagatcaagacgtggaatatacagatcacgacgtggtctatatattccacggcgataatctggaaatagatgagatagtaattatatttgtatatagtaagaagaattttttttacttgaagatacgaacaattgttttgattacaatcgttgactatcctttagatttaagggtaggacacaaaaaagggaaacagttgaataccaaccatttccctttcatcaagtcggggtaccaagattcgaacttgggaccccctgctcccaaagcaggtgcgctaaccggactgcgctacaccccgtcttgcaattcatagtgtttatctctgattgcggtgcaaaggtacgcctttattttaaactacaaaacttttcggtaacttttttcatgaaaaatatcattttcttgttgagtggatagaatggaactttgcgtcagatagttcttatcgttggcgtaaataaataaaagggttccattctttatcgtattaataattggcttactgacagatacaggcaacgcagggcaaccaaggctacgtcctaaccgccccgaggaagctgccacagaaggatcggaataagaggcaccatgaattacaatcgccctttgcttagccaaatcatttattcctttttccaatccatttaggataagcgaatagccattccggccttggtacgtattttccgtcagataaaatcctaaagagcttttatgggaaccgttctcgttcgagaaagaggtcgcataattccctccgctattcttaccgtgagaaaccaaagaggtgtaaagtattctcttttgccgtatatccaatacaaccatacgctccgccgtagaaggtttagagaaatcgatcaatgtaaggatatccttatttttccgatcaatcttctcggaacctctaagcccctgcataaacgcatcgaaacaaacccattgatccaatcgcatctcctcatataattggcgccccataaccgccacagacgttgatctcgtttccggagatagggcacgcaaaacgccaccggttgaaattgaacctacagacaagacaataaaaaacaaatacaagaaaatccttcgcatactaaaaaacaataacgccgcaaagttatgatttttattctaatacaaaaacaatcgtctcattaacaggcgcccaatcgtaaacaaattgcgcatgcgaagtcgcgtttctcacacacatatgagaccgtggtgtcgttcccaacgaaggactatattcgatcaacgatttacgaggagcgttgaccggtacgccatggatatacgccccattcgtaaaacggttggcataaggagcgaatccacctgtctccttggaaccgtctaccaaatagatcatgcgagactttttttcttggagaacatacattcccaacggggtttcctgcgcataaggaggacgatgctgtccggtagtcgcagggttcatgctacgaaccaaccatttcgagccgacgtgctccaaggtcgcgatattctggttatgacgatccacgaagatcgccttatcgaagactaccgtatcccctatttgcttgatatatttcttcggagcataccactcctcctccccatcatacacggtttgtatacgagcgaatttagaatcctcatccatcgccttgatacgaaccaagctaccgtcacgtccatagatctcgggagtcacggtatcagtcagcaaataaagcgggacggattgatagcgttctacaccaagcgtatcggaaaccctcttataggcatctctcttgaagacttttacaagaggagcctctccattcctgtttttatagttctgcaagatcgcccattgagacggctccctttggatcgactccaataaggataatctttctttcattttctcccactggaactcccgtgtcgtatctttataggggtaagtatcttctaaagtatgcttatcgtaaagcagctctttctctatttcgatacggagaggcaaagtctccacgatcacagcggaatccttcgatatagaatccacaggaattaagacctcggtttgagcaggctcggtcctcggcgtacaataacttagcgtacaaaggctcgatatcaaaagtataaaaactgttctcgtcatcattattacccgggatttatttgaatatcgtaaatatacgattttttccaaataacaggtaatcttatcatcttgtttacaaagtaaccgcgccaaatgacagagctatcctatattcatcctataatccatttactgcccggtattaatgagataatctttgtcgtcacataacagcagataaatgtacttaccgcaatgcatggtatggcggcgacagtaggcaaggctaagtcgtgcttaaacaccgttacccacaatccgagccaaaatatatgcataaggtacataccgtagctgagtttagacatctctgttatgagtcgtggagatttcgaattgcctatgcaagtaaaagcgaggaacgtacccgccgtaagaagcacacaattgatcgtacagaaagcccatccgatctctatctcaggtgtgacaagagttactccgggtatcgcttggacatagaaggaataaatcgtcagcaaggcaccgacgaccatcgaggcgattccgataaccagacgtttagaacggttccatgtaagatggacatgtatataatgtgccagtacgaggtatcctaaataaccggagaagtaccacagtatatggtattcgttccaaaaacattgtccccacacctcgccgaagcaacgattgagatagggcatacaggtcgacaacagaaacaagccgatgaaaaaacgctcttctttcgccgtggctttattcaaccatggcgatattacgggtataaataaatagaggctgatcaaagggtacatgaaccacaaatgtccggcctgtgaaggaaagttcaagaatattctcgatatatctttcaatgatgtctcggcatctatctgcccccacagcaagggtaaagtgctgtatagtatcataaatatgaaaaacggcggtaagatgcgaatacaacgctgacggtagaattgccaagaggtcagccctgccttcatcggcgcaagaagaaaggcggagacaattataaacaatggcaccgccatgcgtgagaaaccatcgtatacggctacccacaaccgatcagcctcattggccagataagattgcggtcccaccatatccgtggagccctcagctccataaaagttttcactggcgtggacaaccatgacaaggaagcacgcaaacacacgcacgtaatccaaaaaaactatacgcttcattttttgttttagtattattattcgttagatgatttcaagtttgtctttttacgcgaagcatgcattcaagagggatatatttcgatgtttttcctgatactgctttatggcgcacaaaggtaaaaaaagtcggaaagaatatatacctttgtcatattataagtgaaatctaaaataaaaacatatgagatctattaatggtgcggttttacgtagcgcattcgcgatggtattagggtttgttttggtattatggccggaagcagccataacctatctggttatcacgatcggtatactattcattttaccgggattattcgctatcctcagctatttcacccgaccgaagaacgagaacggggagaaaccgatgtttcctatcgaggcagcgggaagcgtactgttcggagcgtggttggtgatcatgcccgagttcttcgtgaatatattaatgtacttactcggagccttattagtaattgccggtgtacagcaattggtttcattgatatccgcaaggaaatggagcaatgtaccgttggggttctacctgatgccggctttgatcttgataaccggagtaatgattcttgcctacccgttcggggcggcggcaaatacattcgtaatcttcggtgtagccagcattttctacggggcttgtgagttgatcaactggtataagttccgcaagcgtatagaaaataccggattatgatttccggtattccatgggtgatatacccatatgcttcttgaaaaacttaccgaaagtggattgatcggagaagtggagtatatccgctacttgctgaaccgtggcttgcggggccttcaacagcatcttggcctcgacgatcaaggcgtcgtcaatccatttattcgctgatttacccgttagctctttcaagataagcgaaagatactgtggggtaataaataatttctcggcatagaaagtaacgacgtgctgctccttgcaatgctcgaaaagcaattgcaggaactgctcgaaaagctcctccttccgggagagtgtaggtgccgtcatcagctccttcttacccataaagatattagccaactcgataaagaaaccgactaaggcgttttggagagcctccttctggaaaaaatgggtacgcagcttcatcttttcccgtaagatggagaattggccggatatatgctcagtctcctcggcactcatcgcagcacatggattcttacggatctgcatataatgcaccatagagttctttttccctgccggggtagtatatccatccagaaaagatctggacacgatcaacaaacgccctctcaaatctttgctcactttcgatacctgtatgatatgagtcggcatcaaggttataaacgtattcttctctatcttatatggaatatagtctaccgaaatatcagcagtaccttcctgtaccaagatcatcaacaaggcatttaaacgcatcggggtggaatgctccagccttttttcctcgtaattaatcaaatctccgttcagatccgctatcgataaatcatcttgaaagttgtcgctggactcaattcccttgattaactcagtgacttcaattaaaggtaaatttttcatatctatctgtagatttttattatcacctcggacaaagatagaaataaaaagccaaagaccacccactatttcgtttttaaccaattttcatccaaaattgaacgaataacaagaatttttgacaatatcctgtttcattccataccaataccgtaacagtataaacctttctggttttctaaatatatcagacctttgcgaatagattcgacgggaatatccggtcattggtcgattccaacggacgagtcagcgctttttacttgtatacagggattgccccggctacttttgacgtaacaaaaaagaatatgataaaagaacagattattaatacggcgttcgatcttttttctcaatatggcatcaagagtgtgagtatggatgatgtagcgaaagcggctggcatctccaagcgtacactttacgagtcgttcgaggacaaggaaaccttgctgatcgaggggatcgatcacaataccgaatcgctcggacaatatctgacaggattggaaaaagaacctttcaatgccttggaagtaatcctgctcttctatgaggagatgatgaaaaacccgagatggttcaacgagaagttttacgaggacttgaagaaatatccgaaagcccaacaaaaaatagagatgaataaagcgagaatgggtaagaggtgtatggacttgttcacacgaggcgttaaagagggcgtgttccaaaaggggatcaacttcgagatcatggccttactggtgaaagagcagacgaagatgttgcggccttccaatgtcttctgcaagcattccatcaccgaggtatacaacacgatcctcctcacattcctgaaagggatcagtaccgagaagggaagagcgatcctagaccgattcgatctcaaacaatcctatgatttatagcgaacacttaatgagtttaatcacagacaaaatctatcctaaatgaaacgattattgatgagtagaaaaatgatgttggtcacatttatggtattgccttttctggcggcgagaccggttctggctcaagacaccctgaaactggatcttggaaaagcgctagagatcgcccttagcgagaacccgaccgtaaaagttgccgataaagaaatacagaagaaaaagtacgcacgtaaaggctcgtacgcttctctatttccgcagatcagttttgcgggggactacaaccgtaccttgaagaaacaggtgatgtatatggatttcgacatgggtgacatgggaggcggcagcttgcccgaaggcacggacatgtcgagtatggacgagggcttcgaggtaggacgtagcaacaactggagcttgggcttcaacgcttccatgccactggtgaacgcctccttatggaaaagcttgagtatctcggccttagacgtggaattggcggtggagcaagctcgctcttctaaaatagcgatggtgaaccaagtgaaaaagagcttttacgccgtccttctggcaagcgactcttaccgggtattcaagcaaagttacgacaatgccatggagaattatctggatatcaaacggaagtatgaacagggaaccgtagctgaatacgacttgatacgtgccgatgtgacggtaaagaatacagagcctaatctgttgcaggcagagaactcccttaccttggctaaatggcagttaaaagcgttattgggcatggatctggatttaaatatcgattgcgacggacaactgacggatttcaagtccagcctcttcgccgactatctatccacggatacaaccttatccgagaatacggacttgaaacaattagaccttcaggcggaacagctgaaaaagacgctggtcatgcagaaattcgattatctgccgaccttgtcgctgaccggtctatatcaatggagcgccatgaacaatgacttcaagttcaagaattacagatggaacccctattcgatgatcggtatcacgttatcggttcctatcttctccggaggtagtaaattttataaggtaaagcagacgaaagtctccatcgaccaattaaacctgcaacgggacgataccaagcgcaatttgcagttggccgttaaacagtacatagataatatgaatacctgtatcaagaagttcgacgccgcccaaaagggagtcgagcaagcggaacggggatatatgatctcgcaaaaacggtatgacaccggagccggtacatggctggagatgaacgatgccgaacttgccttgacgcaggctcggttgaacttcaaccaatctatctacgactatatggtagcgaaggcggatctggagaaagtattgggtaacgaacagatgaattgaaaattgaaaattaaaaattgaaagtttaatagataataattaggaacaattatatgaagacaagtcaaatgctgaaagtaataccgatagctacattggccctgctgatgtcttgctcgggtaataagagtgaggaagccacggaaacacagaatgagaaagtaaaggtgaaagtggagacggtctctgttcaagacgtggagcaactcagtgaatttaccgctacggtggaagcgaatatcaaaaataatatcgctccccaaaccccattccgtatcgagaaaatcttcgccgaggtaggcgaccatgtaaaagccgggcagttattagccaagatggacgctaccagcctaaagcaagcgaagatacaattggataaccaagagatcgagttcaaacgtatcgacgagttgtataaggtaggcggtgcttccaaatccgcttgggatgcccaaaagacttccttggaagtggctcgagagacgtataaaaacttggtggagaacacccaattgctaagcccgatcagcggaatcgtaactgcccgcaactacgatagcggcgatatgtacagcggcggaaacccaatctacacagtggaggaaatccgtccggtcaaattaatggtgaatgtctccgagagtctttttacgaaagtgaagaaaggccatgaggtagatatccggctggatgtgtacggagacgaggttttcaagggtaaagtcaacttggtttatccgacgatcgatcccgctacccgcacgttccctgtggagatcaagatcgccaactcggatgagcgagtgcgaccgggtatgttcgcccgagtgacgatgagtttcggccatatggatcacgtggtggccccggatcgctctatcgtaaaacaatcaggtgccggcgaccggtatatctatgtatgcaaagacggtaaggtctcctaccagaaggtggagctaggacgccgtatgggtgataaatatgagatcatatccggagtggaggatggcgaccaagtggttatcaccgggcaaagccgcctgacgaacggtatggaagttgaaatcgaaaacgaataacagactatgagtttatatggaacagcggtaagaaagcccgtatcgaccgcccttgtatttgtggcgatcgtgatcttcggacttttttccttaagcaggttatcagtggacttgcttccggagatagagacgaacaccatcatggtgatgacggcctatcccggcgccagcgcttcggatatcgagatgaacgtttcgaagcccttggaaaacgtgttgaatagcgtaagcgacttgaagcatatcacgtcgcaatcccgtgagaatatatcgatcgtaacgttggaatttaattatggcatcgatatcgatgtcgccacgaacgatgtccgcgacaaactggacatggtagagtcttccctacccgatgacgtagagaatccgatcatcttcaagttcggtacggacgatatccctatcttgatcctttccgtgaccgcggaggagagcacgaacgctctttacaagatcttggacgataaggtatccaacccattggcccgtatcagtggcgtgggtgccgtgtctatctccggtacgccgatccgtgagttgcaagtgtattgcgacccgtacaagttggaggcttacggccagaccatcgaaggtatctctaccatcatcgcgcaagagaaccggaatacaccgggaggtagtgtagatatcggctctaatacctactccttgcgtgttcaaggagaattcacggacgctaagcagatgctagacctagtgatcggtagccagaacggaaagaacgtatatctgcgtgacgtggcccgtgtagaggacagcatcgaggaacgtgcgcaagaaacgttcaacaacggcacgaaaggtggtatgatcgtcatacagaaacagtccggagcgaactcggtgaacatcgccaagaaggtacaccagaaacttccggagatacaggctagcttaccctcagacgtgaagctggacgtaatcatggatacttccacgaatatcttgaatacgatcgatagcttgaaagagacgatcatgattacctttatcatcgttatgttggtggtattcgtgttcttgggacgctggagggctacgtttatcattatcttaaccatcccgatctccttgatcgcttctttcgcttatttgctggcctcgggcaatacgttaaacattatctcgttgagctcactttctatcgctatcggtatggtggtggacgacgctatcgtggtattggagaacgtaacgacccatatcgagcggggtagccagccgaaacaggccgctgtacacgccacgaacgaggtggctatctcggttatcgcctccacccttacgatgttagcggtgttcttgccgttgacgatggttacgggtatggcgggtatcttatttaagcagttgggatggatcgttagtatcatcatgatcgtttctacggtaggcgccttgacattgaccccgatgctttgctcacagttattacgccagcaaccggagaagggtaaattgtaccggatgttcttcacgcctatcgaaaagggattgaacgctttggatcgcggttacggacgcttcttgaactgggccgtacgccaccggaaaacggtgatcgtaggcgctacgctgatcttcatcggcagtatgatgctgatcccggttatcaagacggaatttttcccgacacaagataacgcacgcatcggcataacgattgagttgccgatcggtacacggcaggatattacccgtgagttagctctcgacatcgacaagaagttccgtgagaaatatccggagatcctaatcagtaacttcacggaaggtacggcggatacggataataccttcgcccagctaagcaataacggtacgcatattatcgagttcaatataaacctaactagcgtgggcgaccgagagagaggtcttaccgagatttgcgagttgatgcggcaggacttagcccaatacagcgagatcaagaaattcgaggtactcgccggagggcaggaaggttctatgggtggagagacctcggttaacatcgagatctatggttttgatttcgcccagacggatgccgtggcgaatgagatcgcccgtcgtatgagaaatgtaaaaggatgctcgcaagtaaatatcagccgtgaggattatatcccggaataccagatcgacttcgaccgggagaaactggccatcaacgggctgaacgtaacaaccgcctctatgtatctccgaaaccgtgtaaatggttccaccgcttcaaaatatcgtgaggatggagatgagtatgatatcaaggtacgttacgccccagagttccgtgagtccgtagaggatcttgagaatattttgatctataacaatgagggcaaaggcatccgcatccgtgatttaggcaaggtagtggaacgtatgactcccccgaccatcgagcgtaaagaccgtgagcgtgtgatcaccgtatctgccgtagcgggtaagggagcggcattgagcgacttggttgccgccgcccggaacgagttgaaacaaatggatatcccatccgacgtaagttggcagttgggtggaacattcgaagatcagcaggatacatttaccgatttgggtatcttgatggtattgatcatcatcttggtattcatcgtgatggctgcccagttcgagtcgttggtagacccgttcgtgatcatgttctctatcccgttcgcctttacaggtatcgtattgggattggcggtcacgcagacaccattgggcgttatggctttgatcggcgtgatcatgttgatgggtatcgtggttaaaaacggtatcgtgctgatcgactatacgatcttatgtcgggaacgtggcatgggtattatcacatcggtagtgactgccggaaaatcccgtcttcgcccggtattgatgacaacattgacgaccgttttgggtatgatcccgatggcggtgggaaccggcgagggttccgagatgtggcgctcgatgggtatgaccgtggcttggggtctttccgtatccaccttgattaccttgattattgttccgacggtctatgccgtattcgccgccaacggcgtaaaacgaagacgccgcaaaataagaaaggcattacgaaataattaattatctttgcgtaccatagggaagccgaggccaagcaaacctcgatgggcattgttaggtcgtgacaatgcccattgtaaggtgcttacgatgcccattataaacaggcttgaatgcccatcgcaagaaaagcctccctacgggtatgcgatctcataaaaaagcaactatatgaaagcgatatttatatctttcaatcaagcgtattacgagaccatcgtcaatatcatggaccgtaataaccttaaaggttttacctattgggatgtcgtgcaaggacggggaagtaaaacaggcgagccacattacggcaatcacgcttggcctaccttgaattcagctatccttacgatggtagaagacgagaaggtcgatcattttctggaaatcctacacaacttagacaaggaaacggaagcgcaagggcttcgggccttcgtctggaatatagagaaaactatctaacttaatttttcggaacaactatattaatctattgatatggacaaatcaatcctgtttacacccggtaagatcggtccgctaacacttaggaaccgcacgatccgggccgccgcattcgagagtatgtgcccgggaaacgctccctcggagcagttattcaactatcatacatccgtagccgccggagggatcggcatgacgaacatagcttatgccgccgtgacgcaaagcggcttgtcgttcgagcgtcagctgtggatgcgtccggatattattcccggcctccgcaagctcaccgacgctatccataaagagggagccgccgcttccatccagttaggccattgcggtaatatgtcgcataagcggatttgcggatgcacgcctatctcagcgtccagcgggttcaacctctactctcccacgatcgtacgaggtatgagacaatccgagatcgcttccatggctcgtgcctacggtgaggccgtacgattggcacgtgaggcaggtatggacgctgtcgagatccatgccgggcatggttatctgatcagccaattcctttccccgtacaccaaccaccggaaagacgagtatggaggaagccttgagaaccgtatgcgcttcatgagaatgtgtatggaagaggtgatgaaagcagcaggttccgacatggccgtaaccgtaaagaccaatatgcgggacgggttcaagggaggacttgaaatagacgaatgcctagaagtagcccgtacactccaagaccaatgcggagcgcatgccttagtactaagcggcggattcgtgagccgtgcccccatgtatgtaatgcggggagaaatgccgatccgtacgatggcgtattatatgcctaggggctatctaccgattggaatccgcatggtgggtaaatatatgattccctcggaaccgtttaaggaggcttacttccttgaagatgcgttgaaattccgcaaagccttacatttacctcttatttacgtaggaggattggtctccagagacaagatcgaggaggtactgaacgacgggttcgagtttgtggccatggcacgtgccttggtgaacgagccgggcttcgtcaaccgtatgaaagaagacgagcacgcccgttgcgattgtgggcatagtaactattgtatcgcccgtatgtatagcgaggatatggtctgtcataagaacgtgaaaggtcttccggaatgtatcgtacgtgaaatcaaaaggcttgaatataaataatggaaaagaaatgggctttagtcacgggggccagttccggaataggtctcgcctatgccgaggaactagcctcactaggctatcagttagtgatcgtcagcaatgaggagcaggcgatccgggagaaaggtgagtttctctccgagaaatatggtatagaagttttgccgctttatcgtgatttggcgatccccggggcggccaaggagctatatgatacttgccaaaagaaaaacatcccaatagaggtattggtcaataacgccggtatgttttttttctgcgagaccttacaagctaaggccaacatcgtcgagaaaatgctctacctccacgtgactactcctacccagctctgttattattttgggcaagagatgaagaaacggcgtcatggatatatcctcaatatgtcatccctatcttgttggctaccttatccgggaattacgctgtacgcttccaccaagcgatacttgaaaagtttctcccggggcttgcgttcagagttactggattatggagtaagcgtaaccgtactttgtcccggcgccgtcgccacgaatttatataacctaagcgacaacttaaagaccttagcgatccgcctaggtatcatgatgcgtccggaaaaactggctaaaaaagggattaatgccttgtttcaccaccgggcttccctattaccgggtctcttcaacaaaatatgcacacccctcgtaatgctcctcccccacggccttgtccgttggatcatgcgaaccacgaaattagtgaagctagatcgataatccgacaaataacatgcgaaatatttgtcacatcaaacaaaaatcgtatctttgcaccgctttttagccccgtaccgtgtgatgggaaattaggaagcaaaataactaattttgagtaacacaaaaattaaagaaaatgaagacatttgagttagaaggaaaaggaagagagatcgtcgctcgttccgctgatcagaaaagagccttgaaagcaatgcgtaagaacaatgaaattcctgctgtattatacggtggcgaaaaagtaactcacttcacggttacaaaagaagccgttcgtaagttggtttacactccggagattttcgttgttgagttaagcattgacggtaacaagacgatggcaatcgttaaggacatgcagttccaacctgtaactgacgaaatccttcacatggacttcttggaagtatctaaggacaaagccgtagtaatggaagttccggttgttttggaaggtcacgcagaaggtgttaaagccggtggtaagttgtctcttcaaatgagaaaactgaaagtgaaagctatatacgatcaaatccctgaaaagttgacgattaatgtggatcaccttggcttaggtaagactatgcaggtaggtgctttgcacttcgaaggtcttgaattgatgaacgctaaaaacgctgttgtctgcgccgttcaattgactcgtgccgctcgtggtgctcaggctaaaggataatctgaggtaaaaacattattacaatacatgaaggggaggatattcatagaatgttcttcccctttcttttatagattcgaggataatgaaatatttgataacaggacttggtaatatcggttccgaatattggggaacccgtcataatataggtttccgggttgtcaaccatttggtagagagcgtaggaggcaatttcactgaggagcgatacggggcaatcgcacgcatacgggtgaaaaactgtgacttgatcgtgctaaagccgaatacctttatgaacctcagcggcaacgccgttcggtactggttgcaaaaagagaacattcccgtggaaaatctattgattgtcgtagatgatctggcattgccattcggaaccttacgtctgaaaccaaagggtagcgacgccgggcataacgggttgaagaatatcgcccagttattgaatacgcaggaatattcccgccttcgtttcggcataggcagcgattttccacggggcggacagatcgattacgtgctagggaaatttcccccggaggaattgcaattgatgccagagatattggatcgtgcgacagagatcatcaagagcttctgcctcgccggcatccagattacgatgaatcaatttaataataaataaaaagagactgagaatacagatatgaacgaggtacgtatcgataaatggatgtgggcgacccgtatctttaagacccgcacgatagccgcggaagcttgcaagaaagggcgtatcatgataggtggagtaacgatcaaaccttcccgcatgatcaaggttggcgatgtgatccaagtgcgtaaaccgccgatcaccttctcttttaaggtaatcggattgatcgagaatcgtgtgggcgcgaagctcgtcccgaattacttggagaacgtgacaaccccggatcagtatgagattctggagatgaaccgtatctccggtttcgtgaaccgtgcgaaaggtctcggacgtcctaccaagaaagaccgtcgtgaactggagcaattcactgagccggaattcatggatgacggattcgatttcgagttcgactttggagaagaggatgaggagtaagcatgctgatttccactcaattacatttaccaatattttcatcaagaagtaaaagtattttcacctagaggtaaaactgtttacatactgatgtaacgacatttacctctagaggaaaaaacatttaccattagaggtaaatgtcgttacaacggtatgtaaacggcaattattcctattgattctcctcggaaagcagattcccctcctcatcccagctacgccagacaccagatttcttccctgccgtatagaacatctcatacaacaaatttcccttatcgctccagatacgccaagggccgtccttttgcccttccttataagaagccaggccgatcagctggccgttatcgctatacgtgcgccattcaccatggaagatcccgtgatagtaggaacgcacctcggcgatcttgccatccggataatagatcacataggttccctcgggacggccatccttcaggtacagctccatcttgagcatgccatcctcatagaattccgtatagcggcccgtatacggggtggtttgtgtctcatcggtataatactgtccctcgctcaataccaagtcttgcgccagcacggtccaagaggctcccgccaaaaaagcggaaagtaacaatagctttttattcatgatacattcttatctaaattatacataaaaagacaccgagggatctttccggatacctcagtgcctttaacaaattcacaacctattcaatgccaagcttgattaatattcggtattttgaggatcccaattagtccaaccggcagtccagtcattctttccgtcgaaagcacctttgtaagttactttttcgaagaagctgttgttcaatacctcatcgacaaattcagcgccttgcacagctgaagctacgacagaagagtaatcaccatctttagagataatctcgttggtcgttgccagagtcgtgttgctaccggcaagattgaagaagttctcacttaccttatcatcctcatagaagttcttccacataccagcaaagatcacattcttgatggcgatgccatcgtttgccgtacctttcttatcagtagcacgaagtccgtaaggccagccggtgaatacggagttgtaaacattcaagctggtattacgacgcaggtgcatggctgcctggaatttaccacccttggcaccgttagcagcgtcggctgtcttggcttccacctcagcctgtgtcttatcggataccttgccatagaaaggacctatcaaggttacattggagaagaccggcttggtaagcggagtgttggaagaaccgtcaccgtcgttatcagattcaaaaccgttagagtctgaagtatcagcgatattcttatcacgtacgctcaacaagaattgcagtttacccgtataaccgaagtctgtatcgaaatcatcatcccagcctttgtaagcgatcaagtgtttggcatttaccgttccaccgaaccattcgtaagaatcatcgttcgaaaatgaaacctgaacgaactccacttccgtgccgctaccaacgccgccgaaggttaagccattgatttccttgtctggctccaaaggataaccggcaaactcgatacgaacgtatttcaatttaccggaactttccgcattaaactcatcggaggtcgtatttccatataatgtaccaggtcctccttcgatagttggttgattggtacgattcacacgagcgttaccacaaataatcagaccgccccagtcacctgtcaaacgtttacccggctctttatcggacgtaaagacgatcggtttgtcaacagtaccttcggcgatgatcttagcgcccggctcgataatcaaggaagcggctttctcgcccggactaacggacacacctttgataacagaaccagcctcaatagtcaatgtagcgcctgatttcacgtatacgaagcctttcatgaagttcttgtcggcagcgttgatcgttagatcagccgtgatatttccttccaatatcacctctttggaagacggagcatcattagagacagtcacggtacaagtagccgttttaccgccatccttcgtagttacagtaatcgtagcggaaccttcggccacggctgttaccttaccggcatcaacagtcgctaccttttcatcggaagtactccatgtaaccgttttatccgtagcgtcacttggagtaatagtcgcggacaaggtagtggattcgcccaccttgatagtagcggtagtaggactgactgccacagccgatacggctacagagccatcaggtttatcatcgtcatcactacacgatacagtcccaaacataacggccatcgttaacacagaggccaaaccttttaagagaaatctgttcataataaaaacattttgtttgtaatagatatatattcaattaaacatcaaaacctaagggaaacaccgatattgatatccactcccgggcgatagctgcggatcagttgctcacgctcgctcttgccgcctttgtcgtctgtcagtttcacgaactgcttgtactcgaccttggagttcaacatatcctggattcccgccttgatctcgacaatcttgccaatcttcttcgagaaagtaagatccaacgagttgcggggcatctcatatatatcagggatatcctcgttctggttctgcatcgggacaccgaccgactcaatacgcttcccgatccggttatagagcagggaggcggaaatccccttgtcatcgtactggtagaaaaagccggcattaaccaagtagggagattgccctgccaaagggcgatcccgctccggtgccccttcctcaaaacggacacggctatagatatatgcggcgttgcacacaaagctcaagcctcgcagccctataaagtcgaggttctttttaacgtccaactctacgccgaaggtctcggcgttcttcgcgttatgataggtatattgcaggccggaaccagcctcgttgtacgtctcctcgataggatccttgaagtgcttgtagaaaccgccgatcgtgatcatttcgcccgcggctggatagaactcataacgaaggtcgatattgtcagcataggcattcttcagctccgtatttcccacgatgtttgcgtctcgctcgaagttgaagtacacataaggcactacctctcggaactccggacggttgaccgagcgaccgtaagcggcgcggaccaaatgtttttgtgagaggttgtaggcaacattaactgaagggaaaaaatccgtcgtcttattatccaagtgtaccggggtcgtaccgtccgagctatatccgtccatcttcaattggtagtattccatacgaacaccgatattagcgttcaacacctccccataattcagtttagcggagacataggcggctcccaacatgttctcggaagtataagagtcactgttcgtagttgtctcacgcatccatatcttatccgccgagatattttcatcagcgaacaactccgtataatcccagtccgcataccggtcgtagccgctacccaacaggttgtagccaaagcgacgggcagcgaaggtacggctcttatattcaccgtagacacctccattgagaacaggagcgaacctatcggatacggtgaatttatgttcgtagttggcggctatagaggcgctatgatccttcaattcttggtaataacgcatcgggtcagagacatagtagttcggctgttccgtacggttctcgtcaaggatggagttcacgatcttacgatccggctcacggtaggaggcgaaggcatagcccgccgtccaatccaccttgttaacattctctcgcaaggtatgcacaccgctgatctgcccggagtaagtggtacgcccggtatagagggattcccacttacggatattcttgtcggaataatagttcattccttccctttgtgtcagagcggaaacgccacgctggctgaagaagttgcgaagctcatatttgctgccatcccgttggaatgaccagttaaagagggcccctagcttggaggtattcttatagcggatatcgttgtactcaaagcggggacgggatacgtcgttcttcacgtcgtaggcgatgtagttgttattcaccgtctccgagtaatcgtactcggtactccagttcaagttcgtaatatttccgatcttccagccgcccacatcataagagcggtgcgaggtaagggatatcttctgatcggggatggcggtgaacttgttgatcccccaacgttggttgatttgacgggtaaaggcagccgcctcatccgtggagtgttctcctaggtgagcggggaaagaggaaggcaggtttctcacgcccgctccgaatccaaggtaatcctttgccgtgccgtccgtcagctggaagttacggaaggtggcgttcgtgttgaagcccatttggcaggatacgttgaaggtgttcccgtccgggatattcttggtcatcacccgcacgaaaccgccggagaaatccgccggaagctcggccgaggggctcttgtatatcatcatgttatcgatcaaggaagaaggaagcacatcgaacgagaaggcacggctgtccgtctcgctggaaggggtcgtggcgttgttcagccatacattattataacgttgcgcaagccctcgaactacgataaaacgatcgtccacgatggtgattcccgggatgcggcgaagcacctcggcggcatcgctatcctgtgttttactgatttgttgggcagaaatgccgttcacgaccggaaggctcttgcgtacggtatttaatacggccatctcggttcccaatttccgttgggccactacgaccacattctgtaattggaggttagcgtcggaaagctcgatattcaacaccacctcttgacgtgcgactaccggaacatcctttaccgtttgcgtttggtacgacacgtaagaggcggctaccgtataagtacctggtctcacgttctcgatacggaaattaccgtctatatccgtgatagcgccaaccgtagtcccctcgatcacaaccgaggcgccgatcaacggttcttttatctttgcgtccgtaaccgtcccgcaaataacccctgtttgtgcccatagagagaatgacaggaaaactcccacccagaaaagccctaaccttttcaatcttttgccccttaaactctttcccattatcttactacttattatttcatctttgatttcgacgcaaaagtacgggggcggtatttcaaagatgtttagatccaataacaatgaagacaacaaatgttacatttttaagaccgcaacttttccttatcgtttgacatagctaacgtatttttactacatttgcactcctgaatgcataaagacatttaataacatgaagaacattaaaattttcccgaaagactggttgcagttgcatccctataaacaaagcactcccgtggattcctattataccggaatagcgaaccgtatctacgatatcatggagaagaccgagttggtaaactccttcgagggcgaggaaacaaagcagatctgtatccgcatggccgcctacttcgaagacgtgatctccggcatggggctttggcgtgccttcatccttacccataaggagctatacggcaaatacctccccttctacactccggacgatcattattacgacgatgaggtgaaccttgaggacgtgcgttttctcctttggcattatacccagcagtatcacggctatcgtaaaggcactttcgtcagtccggacaaccctgccaacgaatccaccggcatgcttatctacgacctgttctgcaaagagtggaccacggcgccggagaatacccgcatggccaagcttttcgcccttgatacccgctacgagcggcaagaggattacgaccgtctattgcaatggttccattacgaatcctatatcctgcctgagtcggcccgggaactgagcgacttcgcccacgaccgctggaaggagcagcccgacctcaaccaagagcagcttaacaacctgctcgtcaacagccacggcatgatggcctacaccagcaagacctccttgctaggcctgacctccccgcaatggctggcaaagatattgcccgccgagcatcccgaccatgcggtatttcagaacaccgccgacgagtctgtagccaccctgcccgacgatatgctggaggaaaaccgccaacaatacgagactttccgcaaagccgcaggtgacaaactgcttctctatttcgacaagaccgaagatgcacaaacatttatcacggagacttccggccttatccccgccgagaacttccatcttcccgaggactggcaaggcaagaagctggcgatctacgccacgcccgaggaaggcgcccaagtcattacccgtgacgtggagctgatcaaggatgagaacaatcccttctacgacgccaaccgtgccgccaagcaagcgctctctttcttcatcgtgaaacattgcagcgtttacttcctgaaagagctggtagaccgaggcatgttggccgacgcacaaacgaaaagccttaccagcccggaacgtggcaaggcgatcatacaagataattggaaattcctatcccgctatttcatccgagaatatcccgatagataaaacagataggaagcgacatcacaatccgtgacagcgcttccggagaaaaagaagcactgtcgcaatccgtgacagcgcttccggaaaaaaagaagcactgtcgcaatccgtgacagcgcttccggaaaaaaagaagcactgtcgcaatccgtgacagcgcttccggaaaaaaagaagcactgtcgcaatccgtgacagcgcttccggaaaaaaagaagcaccgtcgcaatccgtgacagcgcttccggaaaaaaagaagcaccgtcgcaatccatgacagcgcttccggaaaaaaagaagcactgtcgcaaaacgtgacggtgcttcttttttagtttgtctttcatttagaaaactaaccagccaaatatctttcaaataaaaagaataaacccaataaatacttacaaatagaaacatcagataagatattcttatcttttctccattctttcgctcctacaagcaatcacattatgccattaatacctatatttgcgaaacaaattgacgcaataatcatttatacgcaaacataaggtcaacaaatgaaaacaaacaggaatcattttaatagcagacaaggattatacgacccgtcttatgaacatgacgcttgtggagtaggaatgttagtaaatatccacggcgagaaatcgcacgacatcatcgaatcagcccttaaggtactagagaacatgaggcatcgaggcgctgagggagccgataacaaaacgggtgacggagcgggaatcctattacagatccctcatgagttcatcctcctgcaaggaattccggttccagagaaaggcaaatatggcaccggactaatctttctccccaaagacgaggaacagcaagcaagcatcctcagtatcctcatcgaggagatcgagaaagagggattaaccttgatgcacttacgcaaagttcccgttcatacggaaatcttgggaaaggacgcacaagcgaccgaaccagatatcaagcagatattcatcatcggctgcaacgatcagcaagagctggaactaaagctatacctcatacgtaagcgggtcgagaaaagggtatcggccaccgaccttccggccaaggatgatttctatatagcgtctctttccaccaaaaacatcgtttacaaaggcatgctggaatccatgcagctacgccattactttccggacctgacgcaaccttatttcactagcggactggcattggtacattcacgcttcagtaccaacaccttccccacttggagtctggcgcaacctttccgcctactagcacataacggggaaataaacacgatacggggcaaccggggatggatggaggcccgggagagcgtactatcctcccccagaatcccggatatcaacgatatacgcccgatcatccagccgggcatgagtgacagtgcctcactggataacgtattggaattcttcgtggcctccgggatgagcctgccgcatgccatggcgatgctggtaccggagagtttcaacgagaagaacccgatctccgaagacctaaaggctttctacgaatatcactccatcttgatggaaccgtgggacgggcctgccgccctgctctttagcgacggacgctacgccggaggcatgctagaccgtaacggtctccgccccgcccgttacctgatcacgaaacatgacatgatggtcgtggcctccgaagtcggcgtcatggatttcgagcctaacgagatcaaggaaaaaggccgtctgcaacccggaaagatcttactcatcgataccgagaaaggcgagatttattacgatagcgagctgaaggaacaactggcgaacgcccagccctaccgtacttggctggagaaaaaccgggtggaattggacgagttgaaatccggccgtaagattcctcataaggtagagaaatacgacaagctactgcgtacgttcggatacagccgtgaggatatcgaacgtatcatcgtaccgatgtgcacgggaggggcggaaccggtcggctccatgggcaacgatacgccactggccgtattatccgcccgtccgcaaatcctctataattatttccgccaacaattcgcccaagtaaccaacccgccgatcgacccgatccgcgaggaactcgtcatgagcctgaccgagtatatcggggccgtgggaagcaatatcttagttccaaccgagagccactgtaaaatggttcggctgaaccatccgatcttgaccaatacacaactggatctcctgtgtaacatccggtataagggctttaaaagtgttaagctccccactttgtttgacgcagagaaaggatgcgcaggactgaaagccgccttggacgaattatgtaaacaagcggagcaatccgtcaccgacggcgttaactacatcattttaagcgacaggaacgtagatgagaaaaaagcggtgatcccctccctgttagtggtaagcgccgtgcatcaccatctgatctccgtgcagaaaagggtgcaaacagcgctggtagtggaaaccggcgagatgcgtgaggtaatgcacgccgccctcttactaggctacggagccagtgccatcaacccttatatggctttcgctatcttggatgatctagtagacaggcaagagatacaattgaattacgagactgccgagaagaattacgtaaaagccatttgcaagggtttattcaaggttatgagcaagatggggatcagcacgatccgcagttaccggggagcaaagcttttcgaggcgatcggcctaagccgggatctggcagatacttacttcgggggaaccaccagcaacatcggtggtatccgcttggaagagatagcggcagatgcgatcgccatgcacaatgacgcattctcccaccccacggattctttattggaacataaaggcatttattccttccgcaaggatggcgagaaacacgcttggaacccggataccatttccatgcttcaactggctacccgcttggggagctacaagaaattcaaggaatattcccatgtggttgatgagaaggaaagccccatattcttgcgtgatttcctgaccttcaaacaacgcaccccgatccccttggagcaggtagagccggaagaaacgatcatgcgccgctttgtcacgggagcgatgagcttcggctctatcagccgggaagcgcacgagacgatagctatagccatgaacaagatacacggacgcagtaacacgggcgagggtggtgaggactcggctcgtttcatcccccgtgaggacgggttatcgctccgctccgccatcaagcaagtagcctccggacgcttcggcgtgaccacggaatatctggtaaacgccgacgagatccagatcaaggtcgcccaaggagcgaaaccgggcgaaggaggacagcttcccggctataaggtgaacgatatcatagcgagaacccgtcactcgatcccgggtatctctctgatctctcccccacctcaccacgatatttactcgatcgaggacttggcgcaattgatcttcgatctgaagaacgtgaaccctcaagccgagatcagcgtgaaactcgtatccgagagtggcgtgggaaccatcgccgccggtgtagccaaggcaaaagcggaccggatcgtgatctccggggcagaaggaggaacgggggcttccccgataagctctatccgttacgccggaatcccacccgagctaggactatccgagactcaacagacgctcgtgatgaacggcctccggggacaagtccgcttgcaaacagacggacaattgaaaaccggacgggatatcgtattgatggcgatgctgggtgccgaggagtttggattcgccacctccgccttgatcgtcttaggctgtgtgatgatgcgtaaatgccatatgaacacgtgtccggtaggtgtcgctacccaagatgaggaattacgtaaacgctttcatggccgacacgaatatttggtgaatttcttcaccttcctcgcccgtgaagttcgggaatatctggcagagctaggctatacgaaactagacgatatcattggccgtacggacttactcatgcgtaaaccttccgatcatatcgagaaacatgatctattggatctcagccgcttgatccatctaccggaacaagccgccacgcaggccatccatcatgtcacccgtcaactccacgcgatcgacaacgtgaaagatgtggatataatccgtcacgcaaaggccgccatcgaatccggacaggaagtatcgttggattacgcgatagccaacaccgatcgttccgtaggagccatgctttccggcgagatcgccaagcggtacgggaacatcgggttaccggagaacaccctgcatatcaagttcaagggggcggcgggccagagcttcggagcctttctggctcacggcgtacatttccggttggaaggcgaggcgaacgactatctcggaaaaggattgagtggcggacacatcagtttaatgcctccggtacgctccacctttatagcggaagacaatacgatagccggtaataccttattatatggggctaccagcggtgaggtttatatcaacggccgggtcggagagcgtttctgcgtgcgaaactccggggcgatcgctgtcgtggaaggtgtaggcgaccactgttgcgagtacatgaccggaggccgggttgtcgtcttaggcaatacaggccggaacttcgccgccggaatgagtggcggtgtcgcttacgtatggaacaagaatggtgatttcgattattattgcaacatggaaatggtagagctttccttgatcgaggatagcacctcacggaaggaacttcatgaattgatccgcaagcattatcatcataccggcagccatctggccggattaatgctcgataactggaacaagtacgtggatgagttcatccagatcgtcccgatcgaatacaagaaagtactccaagaggaacagatgcgcaaactccaacgcaagatcgcggagatgcagaaagactactaaatatttacacaaaaacaagagaactatgggaaacccaagagcatttctaacgatacatagacaagaggcgggctatcgtcccgtccacgaacgtatagatgatttcagcgaggtagaacagaccttgaacagcggcgaccgccgtacgcaggcctcccgctgcatggattgtggcgtacccttctgccactgggcctgcccgctgggtaacaagcaacccgaatggcaagatttgttatacaaaggccgttacaaagaggcatatcacgtattggagcagaccgacgacttcccggagttcacgggacgtgtctgccccgccctctgcgagaaaagctgcgtactgaaacttagctgcgacgaacctgtcacgatccgtgagaacgaggcggctatcgtggaagccgctttccgggaaggatacgtacagcctatccaaccggtacgcaacgggaaaaaggtagccgtgatcggtagcggtcccgccggattgaccgtggcgaaccaattgaaccggaaaggatatgaagtcaccgtattcgagaaagatgagttaccgggcggcttgctacgcttcggcatccccaatttcaagctaggcaagcacattatcgatcgccgtatccgtatcatggagcaagaagggattcttttccgtgtaaacacgatggtcggcaaagagatattagcgaaagatgtagtgaaagatttcgacgctgtttgcgtagcgatcggcgccgaggttccccgggatctatctatcgagggacgtcatttaagaggcgtacatttcgccttggagttattaagccagcagaaccggatcttagaaggcatcccgatcccgcccaaaagccagatcaattgcaaaggcaagaaagtcttagtgattggcggaggtgatacgggtagcgattgtgtagggacagcgaaccgtcatggggcggcctgtgtcacccagatcgagatcatgccccagccacccgtcggacagaatccggcgacaccttggcccatgtatccgcaagtactgaaaaccagcagcagccatgaggaaggttgtatccgccggtggaacctaacctctaaccgttttatcggagagaaaaacaacctgataggggttgaggtagaagaagtcgaatgggttccctccccagacggaggccgtccgcagatgaggctgaccggcaagaaagagatcatcgaggccgatctggttttcctcgccatgggctttctgcatccggaacaagaaggattgatcaaagaactgcgattggctaccgacaaccgcgataacatcgccgtagacaacgccggatataccgccaacagcaacctattcgcctgcggagacgctgtcagcggagcgagcttagtcgtaaaagcgatggcctccggccgtaatgtcgcccgatccatcgaccgtttcttacaaaccaactaattttcaactttcaatttttaatgatcatgtgtggtataacagcgatattcaatatacacgacggagcgcaagccctgcgtaaacaagcgttattaatgagtaaacgaatccgtcaccgggggccggactggagtggtatctaccaaggcaaaaccgctatcttagcccatgaacgcctttccatcgtagaccctgcctccggagggcagcctttggtcagccccgacggcaaactcatcctctgcgtcaacggagagatctacaaccatcaggaattacgagaacggttaaaaggcgattacgagttccaaaccggctccgattgcgaggtgatcctcgccttatacaagaagaaagggattgatttcatcgaggatctcaatggtattttcgccttcgctctctatgacgaggagaaaggggtttacttgatcgcccgtgacccgatcggcgtgatcccgctctacatcggatacgatgacgagggacacttgatggtatcttctgagttaaaaggacttgaaggcttcgccactcattacgagccgttcctccccggtcattatttctatagcgaagaccgtaaactcacgagatggtacacccgtgactggatggattatgccaacgtgaaagataatcctaccgacgtacaacaacttcacgatgcgctggaagccgccgtcaaacgccaactgatgagcgatgtcccttatggcgtccttctatccggaggtctggattcctccatcacctccgctatcgccaagaaatacgcggcgaaacgcatcgagaccaatgggaaagcggacgcatggtggcctcaactccactcgttcgccatcggattgaaagatgccccggacttgctcgccgcccgtaaagtagcggatgcgatcggtacggttcatcatgagatccattatacgatacaagaaggattggacgctttacgagatgtcatttatcatatcgagacctatgatgtcactaccgtccgagcctctacccccatgtatttattggcccgtgtgatccggagcatgggtatcaagatggtactaagcggcgagggtgcggacgaggtattcgggggatatttatatttccataaggccccgaatgcacaggctttccatgaagagaccctgcgtaaattaagcaaattgtatttatatgattgcttgcgtgcgaacaaaagcctttgcgcatggggcgtagaaggacgagtgccgttcttggataaagagtttcttgatgtggccatgcgtctgaatccggcggcaaagatgtgcccgggtacgaccatcgagaagaagatacttcgagaagcattttccgacagcttgcccaaggagatcgcttggcggcaaaaagagcaattctcggatggggtaggctatggctggatcgatacattaaagaaaataacctccgagtcggtcactgatgaagagatggcgaatgccgccaaacgattcccaatcaatccaccccaaaacaaggaagagtattattaccgctccatctttgaagagcatttccccagcgaaagcgcagcgagaagcgtaccttccattcctagcgtagcatgttctaccgcagaggctttagcttgggactcggctttcaaaaacatgaacgagccaagtggcagggccataaaagacgtacatgaatccgcttattgacgaatatttcttttctttagtagcaaaatgcaccaacttttatgaataataaacgctggtgcatttaatttttataataactttgccagctagagtcataaaacactttaaaacaaatttatatgaagaaaatctttacatgcattagtttggcagccgctacattcatggctaccaccccagtgatggcacaacaacaaaaacaattaacagataaagaaaaggctgctgttgttaaagttattgttcctgccgtttttgatcaagtaaagcaaatcagtggagttgatttcatgtctctcacaaatcctaatatcgaaagcataattaattcccctttatttttgcctcaagtatcaagcctacgtgcagatcaattaaatccaatctcggttactcctgatagtttaaaattggatcttagttctatggatttttctgcgatagcaccgggaatgggtgatttcatcgcagggatcgttaatgacgtaaaactgacattcagtgattataaagaatataacgtttcacttaacggacaatccgtaaaaattgatttaccagagaaaattgatgtatccgcagctgctttagttgacgcagaaacgggtaaacccacaaatttattatcggtattaatcaagaccgggaacaaaggaaccattcttcctttcaacagcttatccgtagaattgaaattaggttggttaggtaccgtgggtagcatgatccctaatttcccgcttaaagatggaaaattgataagcctaacagaaacagcaaatagctctggtacgattgattatacgattactttagaagataatttacgtagtctagctgcaacgttagctcaagtcccgaacttccaaatatctcttgatatgacaaagttgatgacagaaagtactatcaaggctagcttattcggtaaacctctacaagcacctaacgcaaaattgccaatgggtgacgccgtcgtatatgcaaacttgaaatcaacaacaggcatgcctgcagattctattgtcttgacttcatatgatgccgcatctagcaaaatcaaaggatataagaagttgactccgacaattggcgtatctggagcaaatctagttttaacgacaacagattcagtacgtgctgacgtaaatacagcttggactccaatgtctaaacagatcgttacaatgccagcaacaatgagcacagcaatcaattctattatgtcctctcttgttaatggtgtcgttagtaatcttaaagcaagcgcagaaaccaattacactattacaatcgattctatttacgaagctaaaaaagatgaggttattcgtgtaatggaaatcgacgcaacgacaaaagttgaagctacgagcttaaaagatacaaagatgatcgtagatgtcaacttcttgaaaggaagcagtaaagaaaaagtcatgaatatcaaggctacggctcctacaaatgatactaagattacggtagactttagtcctgctgttgatcctaatggcgatggcgttaaagaaaatgtccgcatggcgacattatatattacatctgacgctatgggtatcatcaccgataacgagactatcagtgacgaggttcaagaggttacggtatctacaaacgctagcggtctttatgtaaagaatggtaagggtaattatgtaatcgttaatatggtaggtagagttgtttctacgggtatcatcactagcgatgagcaatacatcagtactccgaatatgccgaacggtatttatatgatctcaatcgatcagtctaagctcttgagatctgctcataagacaactgttaagttcgtaaaataaattatctagataattagttaatctgataaaaggagctatccggaaacaaaaccgagtagctcctttctttttgtcaatttgtaaaccaaactcccggagagttgatttttctggcctgatgtacttctcgtccctaaatatgagaaaaaatattagcaaatgattgtttagtaatatattagccaaatacgaccttttgttctagaaaaataattcatgctagttcacatttatacgggtcaaaacatattttttatacggataaaagaggcatttcatacggttgtatcgcccgacgcgactatatgtatcgccttatgcgacctattgcgttggctaacgccactacttgcgtcgcccaacgcaacctttcgtgtgacaaaacatgaccttttacgtagaaatcagtggttaaatacgtattttcacccattatctatccctagttaaggcttcttgaaaaagaggctcgtcagacaaacagacttattttaagcaaatagatagatatatagcttttttacttacagttacagcaacccatattcacaaagcatatattacgatataaaaccaaaacacacacttctaattatcatttataactaaaagcatatattataacttcaatctattacaaacctcatatttataaaacattcgagcctctcacctgttatatacttatcaaaacgttatatatttgcattacaataaaacaaaaagaaataatataaagaataatatcatcaaaatgacaaaatcaatcagattcacaaagatgcacggtgccggaaatgattacatctatgtaaacacgatggtctatccgatagacaatcccgaggaattatctatcgcatggagcaagccgcacacaggcataggatctgatggtttggtcttgataggttcttcagacatcgccgatttcagcatgcatatctataatgcggacggctccgaggcgatgatgtgcggaaacgcatccagatgtattggcaaatatgtctatgaggccggcctaacgcaaaagaacaaggtcaccttagagaccttatcaggtatcaaagagctacaattgaaaatagagcgtgaagaggtcaccgaggtcacggtagatatgggaatgcctgccgtaggcgagatggccttggaggttgaggctggaggagaaatttacaccggcaccgtcatctctatgggaaatcctcacttggttatcttcgtggacgagatggaccaggtcggtctggcaagcgtaggcccgttactggaatgcctcccgctttttccggaccggacaaacgtggagttcgtgcaggtgctaaagccggacgaggtacggatgagggtgtgggaacgaggttccggcatcacacaagcctgcggaaccggagcttgcgccaccgccgtggccggggtcgtacgtgggaagacaaagcgaaagacgaaggtcatcatggatgggggccctttaaccatcgagtgggacgagcgaagcggtaaggtctttatgaccggcggagcggtcaacgtgttcgagggattcatcaaagtctgacacggggaacaagacaaaacaacaaaaacaacaacataaaaacaaaagaactgagtatggcactaattaatgaacatttcctgaaactacagaacaattaccttttctccgacatcgcgaaaaaggtaaacagcttcaaggttacccatcccaaagataagatcattcgaatgggtattggtgatgttacgcaaccacttgcccccgccgttattgaggcgatgcataaagccgtggaagaaatggcgagcaaggatacattccacggatatggccccgagcagggatatcctttcctaatcgacgctatcatcaagaacgattatgccagccggggagtctttatcgaaccgagcgaggtattcatcagcgacggagcgaaaagcgattgtggaaatataggtgacatgctccgccacgacaatagtatcggggtgacagaccccgtatatccggcctacatcgactcgaacgtaatgagcggacgcaccggggtattggaaaacgggaaatggagcgatgtcgtatacatcccttgcacggaggaaaacaacttcgtaccggatctgcccagtcgcagggtggacatcctttacctctgctatcccaataacccgaccggaacgaccttgactaaggacgaattgaagaaatgggtaaactatgcccttgccaacgacgtgcttatcatgtacgactccgcttacgaagcttatatacaggacccgaatatcccccactctatctacgagatcaaaggagcgaagaaggtagctatcgaattccggagcttctctaaaaccgccgggttcacggggatacgttgcggatacacggtcgtaccgaaggagctgaacgccttcacgctggacgggcaacgggtacagttgaacaaattatggaaccgtcgccaatgcacgaaattcaacggaaccagttacataacccaacggggtgcggaagcggtttattccaccgccgggaaacagcaagtgacagctactatcaattattatatgaccaacgcgaagatcatgaaagagggcctgcaaaactgcggtctcacggtgtacggaggcgataacgccccatacctctggctaaagaccccggacggcctctcctcatggaaattctttgacaaactgctttatgaagtcaagatagtcggaacccccggagtgggattcggaccgagcggggaaggttatctacgcctcaccgctttcggcgatagggatgacaccctagaggccatggctaggctgaggaagtggctaagataagtcatttactataaacaacaataatcatcaggtattatgtcaaagttaagatttagagtcgtagaatcggcgttcgagaaaaaagcgaccgagctaaccactcccgccgagagaccttccaagtattacggcgagctggtattcaaccgtgagaagatgttcaaatatcttccagagagagcgtacgagagactggtggactccatcgacaacggtaccccgttagaccgtgagacagcgaacgccgtggcctccggcatgaagaaatgggcgatggaaaaaggcgctacccactacacccactggttccatcccttgacggaaggtaccgccgagaagcacgatgctttcatcgagcacgatggcaaaggcggcgtacttgaggaattcgaggggaaactactgatccagcaagagccggacgcctccagtttcccgaacggcggtatccgcaatacgttcgaggcccgtggctactcggcttgggatccttcctcccctgcttttatcgtaggagacaccctgtgcatcccgacgatcttcatcgcttacacaggcgagtccctcgactacaaagctcccttgctgaaagccttggaagccgtgaacaaggcggcggtcgatgtctgccactacttcaacccggacgtgaagaaagtatacgcctacctaggttgggaacaggaatacttcctagtagacgagggcctatacgccgcacgtcccgatctgttgatgaccggccgtactctgatggggcacgagagctcgaagaaccaacagttggaggatcattacttcggagccatccccacccgtgtcatggaattcatgaaagacctcgaggttgaggcattgaaacttggcattcccgtaaagacccgtcataacgaggtcgccccgaaccaattcgagctggctcccatcttcgaggaatgcaacctcgccaatgaccataacttactgatcatggccctaatgcgcaagatctcccgcaaacatgggttccgtgtcctgttgcacgagaaaccgttcaaaggcgtgaacggttccggcaagcacaataactggtcgctgggaaccgataccggaatccttttgatgggaccgggtaagacgccggaagacaacctgcgcttcgtgaccttcgtggtcaacgtactgaaagccgtgtacacccataacgcattgctgaaggccagcatctccagcgcgaccaacgcccatcgtctgggagcgaacgaggctcccccagcgatcatctccagcttcttagggacacagctatccaaggtattggaacatctggagaacagcgatacggaagatttcaacctagcgggaaagcaaggcatgaaactcgatatcgcccgtatccccgagttattgatcgataacacggatcgtaaccgtacctcccctttcgccttcaccggtaatcgtttcgagttccgtgccgtaggttcctccgcgaactgcgccgccgccatgctggtattgaacgccgccgtagcggatcagttgaggcagttcaaggccgaggtagacgctaagatagccaccggaaaggataagttcgccgctatcatcgaggtaatccgcaaggatatcaaggaatgcaaggcgatccatttcgacggcaatggctacagcgaggaatggaaggccgaggccgcacgccggggcttggattgcgagaccagcgtgcctttgatcttcgacgcttatttgaaagatagcagcgtccgcatgttcgagtccacgggagtcatgacccgcaaggagctggaggctcgcaacgaggtcaaatgggagatgtacacgaagaagatccagatcgaggcccgtgtattaggcgacctgacaatgaaccatatcatcccgatggccaccaaataccagtcttccttgatcgacaacgtatataagatgcgtgaattattccccgccgataaagccgcccatctatcctccaagaacatggagatcatcgaggatatagcgaaccgcacgatcttcatcaaggaaaaagtggacgagatggtcaacgcccgcaagatagccaacaagatcgagagcgagcgggagaaggcgatcgcttaccacgaccggatcgtcccgatgatggaagccatccgttaccatatcgacaagttggaactggttgtcgacgaccagatatggaccttgccgaaataccgtgagcttttattcatcagatagtcttattcagacagtagttttttgttgattgttttgtgttaataaggagaggatgctgcgaagtatacctctccttcttttttatcccatacaaaatacatacctttggggcataaatatataggagggaaattgatatgacgacaatagagttacagcaatggagagaaagcttcgtggagagataccttaacaagatcgatgacatggagatatcggaggaactggaacgggctgccaaaaagatcttttccaagagaaggacaccccgcccttgcgtaatccactcgcaagaggagatgatagcagaggtacggaaatcggtagaagacgcccgagaaggtagagtcacatcaagtgaggatctagataaagagatagagacatggttctgaaacagaaaaatccatattggacagccaaggccaaagaagatttgaaagaaattacgaagtattataagaaggagatttctatcaacatggcccacaagaaagtcaaggacctgaaacattacgccgatttgttagctgacaatcctcttctcggtttttatgagcaagctttatcctcggagccgcaaggctttcggtctcttgttcatgaacattacaaaatcatctattttatagaagatgatatcatctatatctccgcgatcttcgactgtcgtcaaaaccccgataaattaagaacatctatcagataaacaataacaaatatgaattacggattcgtcaaagtagcggcagccgtaccacatgttaaagtggctgactgcttttataatattcaacagatcgagggattgatgcgccaagcgtcccaaaaagaggtccagatcatcgctttccccgaattatcggttacgtcttacacttgcatggacttgttctcgcaagagaccttactcagaaacgccgagaaagccttgctggatttagtgaacaacaccgccgatctggatttactaacgatcgtaggttgcccgcttgtcagcggaagccaactgataaacgccgccgtcgctttccaacggggcgagatactaggggtagtgcccaagagctacctgcccagctacaaagagttccaagaagagcgttggttcacggcctcttcacacctacagcaatccatgatcacgatcggtaaccgggaagtgccgctggattgctacctgatcttcgagtatgatgaggtacgtgtgggtatcgagatctgcgaggatctttgggttcccatccctcccagctccgagctagccatgcagggggccaacttgatattcaatctatccgccagcaacgagttgatcggtaagcatgcttacttacgatccttgatctgccagcaatccgcacgttgtatcgccggatacgtctacgcatccgccggtttcggggaatccagtaccgacctcgtattcgcaggaaacggtatcatagcggagaacggcacgttgctgaaggaatccgaacgtttctccatggaggagcaactcgttatcagcgagatcgatatccagaacttacagaacgaccgacggatcaacaccagtttcatgcagggttatctcaaccataacatggataacggcaccgtagtctcattcagccttcccaaccggacactggatttgacccgggcaatcgacccgcatccctttaccccctccggcgacgcgctgaaagaacgttgcgaggaaatattccatatacaggtagcgggactcgccaagcgtatcctccatgcccacgcccaaaccgccgtcgtaggcatctccgggggactggattccaccttggccctactggtcaccgtcatgaccttcgatgccttgaagatcccacgggataagatcatcggcatcaccatgcccggcttcggaacgacggatcgtacctataccaatgcctgcgacttgatacgctcccttggcgtgaccctccgggagatctccatcaaggaggcttgcgtccaacatttcaaggatattgatcacgacatccatgtacatgacgtgacctacgagaacagccaagcccgcgagcgtacccaacttcttatggacgtggcgaaccaagcgaacggcctcgtgatcggtacgggggatctctcggagcttgccttgggctgggctacttacaatggcgaccatatgtctatgtacggcgtcaacggtagcattcccaagacattggtcaaatatctggtggaatgggttgccaacaacaaggtagacgaggcttcccgcgccacgttattagatatagtagacactccgatcagcccggaattgattcccgccgacgagcatggaaatatcaagcagaagacggaggatttggtaggcccctacgagctgcacgatttcttcctctatcacttcctacgcttcggtgcctcccccgcgaagatttatttcttggcgaagcgggcattcggggaaacctacgacgatgccaccctcaagaaatggctccataccttcttccgccgcttcttccagcaacagttcaagcgcagttgcctgcccgacggcccgaaagtaggctccatcagcctctccccgcgtggagactggcgaatgccgagcgacgcgatggctacgctttggctggatgagatcgcagggctttaacattcgttcacgggtatggtcatagacgaggctctctcatgggtgtcgaagcctcggctatgacccgtgagagagcctcagttatgatcggtgagaaagcctcggctatgatcctgcctaatcgaactgcgtgatcaccctccggatccgggtgaagctatcgccgtccttctccagtttatagatgtgcttataggacagggcatcctgctcggtcggtgagccattgatcaagagaatatcccggtcgttggcgaatttcaagatccccgccacgttattcgggtgtagcttcccgatctcatccatcatgcaatgtagcttgaaatcagagaataccgtggaggcgttccgcttgaacacgttcagcaacatgatattcaccatggatttgaccaagatatccgtaccctcggagcctacgttcgtaaggcgctccacgaagcccgtatcattccggttctcgatcacccggaatttaaggtcgaagaaatccgccagacggatcaagttgccggaataagcgtccatcgacttgatcaactcacgtagcaacgtcgtcgccttctcccgggtagccgtatcgtcggccgaggaagcgaacaggttctgccccaaatcccagctatattcctcgttgaatcgcttgatctccttcaacagattgacgatcttgttctggctcggatcgatacgcatctcgatacactggataatccccacgaagttcttctccttgaaatcggcgttgatctgatccaccacgccacggatattgccttcctgagagaccatgcttttcgtgtccgccgtaatctgccggaagatatcggagttgcgggtattgatacgcaattggtattccgagaccttgtcctcgtcgataaactccttcaagtcgcaagcgaaatccatatactctttatcatccgagaagctcgtcttgaaggcgaacacattatcctcggagaaattgccggtgtaggcggttatctccttgcgcagctcggaaagtttctgggattgctcgctgacgcagatcgtgatctcccgtaccaaggaacggcaatcgccattcgtatccgtacggttcatggaagagaagacggattccctagaggtaaaccagtccaacagggtagagcgatgatattcctcccggttctccaacgctttccggttggcctccttcagctccttcagctcggcatctatcttgaagatattccggttcacgtccgccagacgctttttcaattcctcctgttccccgtggatgatctgctgcaaacgtaggctctccgccgtccagtcaggtaccttatccagcatctctcgtttatctttcagatactcgataatcaaagccttggtctcgttgatatacttgatctccccaccgatatacgccaagcgggaatgtatctcctccaaacgcctcggatcgccaccactggcggtcaggctatccaattgctccctgtcatatccggatttgcgctcttccagctccactttcttgcgtgcgatctcctccgagatagcttccctccgggcggagagttccttatccaaagcagccaactcatctttctcttgctcatccaaggaagcgagttcccggtccatcttgccttgaagcgtggcgatctcctgccggatcgaggaaagggcggcctcggcagcgttcaactcctcctccaaacgccggatctcctcctgcctcagacgggtcgcctgatcccgcaaggccgacagacgagactcgtcctctttcttgcgaaccgccagttgctccaactcatattccgcgtgatagatatcctccttgatgggcttcacggaggattgatattgcttgcggagattctccttggccgcctccaaatcctgccgcgccgtagcgatgaagcgctggattccggcacgtttttcctcggcctccttcttctccgtcaagtaatcctccttggtcttgacattccggtgaatcccggaggtgaagcggattccataaaaggtatctccctcgcctacctccgccgtaaactctttcccgtaaagcaggcgctcgtcacacacttgcccgatcgtctgctcccagccgggtttatgctcggacagccagttgaagaagctatctttctggttatccaagaattccgtcagttccgctagcttagcgctcagggcctcgatcttcacctcgttggattccgctagcttttgataatcctcatccaaatgcttctcggcggtctcgaactctttcatctggtagttcaactcgtacttcagctcacggatcttcagctccaagtccttccggttcgcgtcgtaattaccgagacgccctttgaccgcctccaattcctccgaggttcccgactgcccccgggcagtcttgatacgcatcttcaaggcggcgacctccgtcgtacgtttctcccgatccaccaacaaacgctctttctcctccgaggcggcatggcgcgattcctcccgtagccgtcgataatactcccggcgagcctcccgacgagcattgatctcagtctctgccgccagtaattgtttctgtttctcgttctcgaagccggccaactcgttcttcagattagcgatcaaattggcgtgcaagaccgaggcttctttattcttggaagaaagcaaatctttctccacgactaaggattcctgttcctgctgtaagatctccaatttgttacaacgatccatcgccgtctggatatcttttccggcatagaaaacccgtttcgcttccgcctccgacaaggcgtttttcagcacggccaactcgccttccatcgtggctgtccggttcttcgattcagcgtccagcttatccctttgcttatagaaatccgatttgaccgcctcctgctcgtgtatcttccgggacaactccggcaagatacgctccgtttccagataagccccgcgcaattggcggcacagatcgttgatccgtaaatcccgcttacggatatcgtccgacaaggtagagatcccagcggccttccgcgccatgcccggctcacggaaaacaccgatatcattcagttgcgcctcaaaaccggatagatggctccggtaacggctcaagtcgatcacgctatccgcctcgttcaaggaggtgatgatcgtctgcttgatataatccgcctccaagcgtgaattcagcaagacgttctggatcgtacggatgatattctgatacgagccgctctccatcaaggaataacaggagtaatcccgtttattatccgagtttccgtagaggatattccggtattcctcatacgtggagatcgccccgctatatttgataccgttcttatcgagcaccgagcggatacgatccgacggataaggcgctccctcctcgtcgataaaaagatccggccggtacggagaggcgataaaacggtagcagatacggttcatcgtcttataactaagtaccgtaaaccaaccatcctccctcgctacctcgtagatgatcgaggaatcggcataagggaaataataatcctgatacgacttcttctcgaccgggattccgagccgctgcgtatcggcgttgtaaaagaaaaggatcgcacggaggatcgtactcttccccactccctgcgttccgattaaatgtatatttccatccagctgtacttccgagtaacggatagcggcgctgtttataaatactattttattgagatatctcatcttcgttctttatgttaatactatggatcatcttcgtgaggtagtcccacgaggagagcactttccacgtcccgttcatatcgcttacgcactcgataaagccctctttcgtcatcctgtccaagatggtatcgaggatatccttgcgtttctccttgcctccggtatgttttttcaacccgtccagcttcatctctagatccatgtcgatacgggaacgtaccaatatctccgccggcgagaaagtgaaaccgggcccgaaggccgtatcgtacgtacagaagaagtccatgatatcgatccaagcgaagaaacgctggagcttttgctccaaggtagcccggggctccttgcgggagaagtagaagtaattattcccctgctccaacacgaaattgatatgcgagaaataatcacgtaaacgctcaaaattatcttctacgaccgagaagagtgtcctcaactcctttacacttgtattcgagcacagaaaattacctttcgacaggtaatcatagatctgtgcggtctgtaccggtaaattatctatcatccttattattattgttgttctattttatccagttgtagagacggggcgtgccccgtctcatcacagggggcacgccccgtctctacaactaggttctttgaataatggcatattctatatgctccatatgcccaaaacggtctgttatctccaactcattctcatagagggagagtaaacggcaaaataacgtaaccttcgcctcgaaatccatcttccggttataatcatacgccatcacgaaagagaacaaatcccctccggtccggctaaaaacatccatcatcttccgggtattgatagcagcctcccccacctcttgattctccatctgctcggcggagatcacccccagctcctgccggtggatcaccttgtccggccgtatgccgtcggccaccttcaagatgacatcctgtgcctcgtccgtttgcaaataaggaatggaaaccttgaataaggtaggctgcacgccctccaataccacggaacgctccgcatctaccacctcccgcacgttcgtgttctcctgtaactcaaactgctcccgcagatatttgatacgacgcagcttacgggtaaaacccacctgcgtacggatctggttcaagtaatcaatgatatcctgttgggaatggatcaagctatggccggcgctcaataactccgtcttcaactcacgggcgatcgtcaacagctcctcgtccggggcttgggcgaaaaagggagtccgttcccgatccagcagcttctccacttccacgatcaggcggttgatctcgattcgtttagcgtccagattctccagtttggcgatcttcaccttatagctcggctcgttcttgaacgtattatcgatcacccgttgcaaggacaccacgttacgtaccaagatcttcccgatcttccgcaaatgcgccttgaccgatcgcagatagcccaacttacgcaaatcgttatcctccttgctataataatcgatcaattgatacaccaactggatattctcatcgatcaccgaggtagaaatctcctcattcgcctccagaagcagctcatagaaagagagataatgctcatccatctcgatataagggccgttcctgcggatcacctcacgctcgatcaagatattcaatttattctcatcgataatatccaacgcataatcatagcgaaacggtaatgattttcttttctcaaataagacctccaataggtcctttcccagatttagcgtgttcgttatatggggtattgaattatatatgtacatcctaaacaattaaggacacaaaggtaataaaaatacaagtaacccttttttctccgtgatgaaaaaggatttccatcgtagtgaaaaagctttttcatcacggtggaaaaagtttttcactacgatggaaaaaatggaaaatcacgaagagttatcaatccgccggatagacaattcccaactgccggcgtacttcatcgataatctccaatgtaatcaaagaattatcaaggctattgatttctgactcccgcttgccagacaagacgaggttgataaattccgctacctcataatagtactcatccttatcggcgaccacgcttaggtcttccggaaccggttccgggccttttcccatcgccggagctagacgaggagaatacgtcactttacggatgatattgattcggtccaaggtcaagttcccctcctctccttgtatctcggtaggcaaggcggagttggcgatcttagaataaagcaccgtggcgttcatcccctcatacaagaaattcacggccccttgcccgtccgctcctgaggacaggactatgcccgaggcgtctatcttctttgggcgaccaaacaagacaaccatcggatagaccgtataaataccgatatccatcatggccccattagacaactccggcttgaaagcgttcaacacgattccttccttgaacttatcataacgggaggaatactggcaatagcaggcgaaataacgacgaaccgtacctacacgctcaagattctctcgtacggcaagaaagttcggcgtaagcgtaggcttcatcgcctccatcaacgtgacattataggtacgggaagcctcgatcatcgcacgtacttcttttgcgttggaagcgaagggtttctcgcaaagaacatgcttgccatagctcatgcaaagaatactctgggaggcatgaaggaagttcggggaggcaatatacacggcgtcgatcaacgggcttttcgccatctcctccaaggaggtaaacgtatacggtatattatgtttcgaggcgaaagcatccgccgtctcctgagttctcgaatatacagctaccagttcaaaacgctcatcctgccgggctccggcaatcacccaatcggttatgaaattggttccgactacaccaaaacgtactttatccatattctatcgtattatgttcttcgcttacaaatgtacgatttctgtttaacataaatactccgtggaaatgttattgtatctataaaatggataagccgcaggaactttttcgcaacgacgctgtttaatctatacaatttaaaaccgttttaaaactaaatcaagtatgaaaagaattgtatcttttatcgtcgttctcgctgtcgctatgtgcggaatgacacaagtaatggctcaaaaatcgataacaaaggaagccaaaaaagtagagagagaaatcaagaaacaagagcgtctggcacaagatgccgtagaaggccaagaagagtttaacgccgctgtacaagctatcaacaaccaatcattcgtattggaggctaacaacatacaaccgatgaacggacaggtattctacgtaaattcaaatacgaacttcgtatctttgaatgacggacaggctatggtccagatcgcgtccaactctccgtatcccggtcctaacggattaggtggtatcaccgtacaaggtagcgcctccaatatccagaccaagcaggatgacaagggcaatgtttatctgaacatgaacgtacagggtgtgtttatctccgctaccgttagcttgatgcttaccaacggaacaaacaacgcaaccgttaccgtagacccgaacttctccggtagaaacttgagaatgaccggtaccctacttccgtactcacaatcgaacattttccagggaacaacatattaatcatgtccaacttttctataataaggaaggcggtgctccgtgaggaacatcgccttcgaactatttatagatagccttatctcttatttacggaaaggagcctttaccacttgagccttcaagttcttattacgcaccttgataaagatatccgtaccagctttcgcgaactcaggtttcacgtatcccataccgatccccttcttcaataccggagacatcgtaccggaagtaaccacgccgattacattcccttccgcatcggcgatctcatagccatgacggggaattcccttttcctgcagctcgaaagcacacaacttacgggttacgccctctttcttctgacgctccaattccgcacgattcgtaaagttcttaccctcggcgaacttcgtgatccagcctaaaccagcctcgatcggagaagtcgtatcatccaaatcatttccatacaagcagaagcccatctcaagacgaagcgtatcacgtgctcccaaaccgatcggcttgatcccttccggctttccagcctcgaagatagcgttccagatcgtcatcgcatcactcggatagaaatacaattcgaagccacccgcaccggtataccccgtgttggagataatcacgtttttgcaaccggcgaactcacccgtcacaaatgaatagtaaggaatagaagataaatcaaccggagtaagacgttgaagaacctcctgtgctttcggtccttggatagccaattgagccgtacggtcggaagaattctccaattcggcacctaccgtattatggcttacgcaccaatcccaatccttgtcgatattaccggcgtttacgaccagcaaatatttctccggctcgtaatgatataccaaaaggtcatccacgatacctcccttgtcgttcgggaagcaagtatattgagccttaccaagcggcaagacagaagcgtcgttagaagttacgctttgaatgaaagccaaggcgttcgggccttttacccaaaactcgcccatgtgggaaacatcaaacacacctacaccattcactacagtcatgtgttcgtcgataattccggaatattcgataggcatattgaaacctgcgaattcgtgcatctttgcgcccaacgcgatatgcacgtcggtaaacggagttgttttcatgtaattattgcatttaagatttacgagccgatagctctatgatttttataactgtttccatactcttctccaacgaacgaacgggcaagaactcataacgtccgtggaaattcaggcctcccgcgaaaatattcgggcaaggcaatcccataaacgacaggcgggcaccatccgtacctccccggatcggtttcacgatcggttctaccccaacggaggtcatcgcctcaaacgccaaatcaacgatatgtttctggggctccacaacctcgcgcatattgtaatattgatcccgaagctctaaatgcgcacatcccggatgcgcttcattcatcttatcaaccaacgtacgaagcaattctttcttctcctcgaacaacttccggtcatggtcacggatgatgtaagatagagtagcttcctcgaccgaaccggtcataccggtcaaatggaagaatccctcataaccagtcgtatgctccggacgttgctcggccggcaaccaagaagcaaactcgatcgcacgcaaggaagcgttttgcatcttatccttggcgtatcccggatgtacgttcaagcccttgaagataatcttagcgccggcggcattgaaattctcatattccaactcaccgatttgtccaccgtcaatcgtatatccccaatcacaaccgaacttctccacgtcgaaatgatcggcaccttgtccgatttcctcatccggggtaaaagcgatacggatcttaccgtgcttgatctccggatgatccttcaaatattgcatagaggcgacgatagcggctacacctcccttatcatcggcacctaataaagtcttaccattcgttacgataatatcctgtcccttataatctgaaagctctgggaacatcgattgagatagtacaacattttcttccgcatccaagacaatatcaccacccagataagtcacgatacgaggctggacattcttacccgacatatccggactcgtatccaaatgagcgataaaaccgatagtcgggattttctcgtccgtattagccggcagagtagccattacataactattctcatccaaggagatctcctccataccaatcgcttccaattccttcaccaaagcctcggcaaagacacgttgtcccggcgtactaggagtcgtacccgtctcctcgttcgactgggtatcgaacgtaacgtactttaaaaatctatctaaaactgtcataactcactcttttaaaacagccataaaagtagacaaagcaagttacatgacaaaaaaatagcgagacaaattgtcccgctattcctgtttctctcaaaaaatgtcatcaaaagcagcttgaaccgtcgaagcagtgcgtacaaaccttacacttaggcaagccgatcgcctccaccaaggtttccagcgtattaaacttcaaggaactcaacccgaaacgctcggcgataattccgaccatcttcttatattccggagagtctgtcgtagcatatttatccagattcttattctcatccccttccagttccttgataatctgacgagttatcaactccaaaggactcttggaagaagtaaaaccgataaacgggcaactataaatcaatggagggcaagcgatacgcatatgtacctctttcgccccataatcatataagatcttcacgttatcacgaagctgtgtaccacgcacgatcgagtcgtcgcagaaaaggatgcgtctgccttccagcatcgcacggttcggtatcaatttcatcttagccaccaaagcacgcatctcttggttagccggggtaaaactacgaggccacgtcggtgtatacttagcgatagcccgatgataaggcacccccttaccttccgcatatcccaaggccatacccacgccggagtccggtataccacaggcgcaatccacctccgagtcatccttctgccccatcttatatccactcataaaccggacatcctccacgttcttaccctcatagcaagaaaccggaaatccataatacacccaaaggaaagagcagacctgcatcccttcattcggtttacgcatctgctccataccatcggcacgcaaacggacgatctcgcccgggcctataaatttctcgatctcataatccaagttcggaagactgctagactcactggtcgccgcataagctccgtctttcttcccgattacgatcggcgtacgcccccacttatcacgggcggcgataataccatcctccgtcaggagcaacatagagcaagagccctttatcttattgtaaacattctcaataccctccacgaagtccttgccttgtgtaatcagcaaagcgactaactccgtctgattcgtttttccggaactcaattccgagaaatgcatgttcgcttccaataactccttttccagctcgtccagattattaatcttcgccaccgtcacgatcgcgaatttacctaagtgagagttgataacgataggctgcgcatccgtatcgctgataataccgatcccggcttttcctttgaatttaggaagccccggttcaaacttggtgcggaaataagaattctccagattgtggatcgaacgcgtaaacccttcttccttatcgtacgtagccataccgcctctgcgggttcctagatgagaattgtagtctgtaccatagaataaatccgtaatacaggctcctttagaaatagttccgaaaaaaccacccattgttttttatgtttgtatttatgtttgagaccgcaaagttacaagtttatttatatatgttccaaaatttacttcataacgtttattatcatcggcaataaaaaaaggataccccttttcaggatatccttttccttattctttggtcgcagaaacttaagcctcagcaacaacttcttttacagaaacaaatgatctgttttcttttcctctacggaaagtaacaacgccatctaccaacgcatacaacgtatgatccttaccgatacctacgttctcgcccggatgatgaaccgtacctctttgacgaacgatgatgttaccagctttagcaacctcaccaccaaaaagcttaacacctaatcttttactttgtgattcacggccgttcttagaactacccacaccttttttatgtgccatttcttttcttctcctttaaacgttaagcaataacttctttaatactcacctcagtgaactgctgacggtgaccgttcaatttacggtaaccttttcttctcttcttgtggaataccagcaccttgtcaccttttaccagcggagataatacctcgcatactacctttgcgccctctacagtaggaacacccactgttacctcaccgttgttatctactaacaacaccttgtcaaactccacaacagcaccgctttccgcgttctgaatgtgatgaacgaacaatttcttgccttgctcagccttgaactgttgtccgttaatttctacgattacgtacatctgtcttaaaatcttttaaacaggttaggtcccgggggtgggctccgtctccggctccacttatttaccctctgcggaaaatcgagtgcaaagatagagttttttatttaattccacaaacatcttcttgaacttttaaaaagccacgcataagacgatgagaatacagagctttttactacctttgcaactaataatatattactattatccaaataaagatgcaggaaacaaacaatatgttatcagttcttgacaactatacgctagacaacccggatgagatcgctaaagaaatagccaacgacttccgcaagcgacgtatagagaagaatctgacacgcgaacaagtgtcggagaaggcaggtgtagcagtcagtaatatcgtgcgattcgaacagaaaggtcttatctcactcaagaaccttatcggcatagcaatggcattaggttacacttcggagataaagaagcttttttccgaaccaaaatactccaccatggaggagctactacaaatccgcaagaataccaacaagaaaaaagtacataagtaatgagaatcaaaaaaatagaaagacttatcgtaaagtatcacgaacagatagtcgggacgctttcgctcactcccgacaacaaacagtgtgcctttgaatacgataaagcatggctttccaacggtttcagtatatccccattggaacttccgctgaaaccgggattgttcatcgcaaagccctcacctttttatgggaatttcggtgttttcgaagacagtctgcccgatggctatggtcgctacctcttgcataaggccttgctcaaagaaggcatcaacgatacccaattgtcagcgctcgaccgtctaagtctagtgggaaatgggggtatgggagcactcacatacgaaccggaaaccagcataggtacttcgcatgagccccttgatttcgatctgctgcaagaaaaggccttagaagtgttgcatgagaagaacgacgatgacgtagaacttcttctttttaacagccgaaatagcggcggatgcagacccaaggcattgttctccaacaatgaagggcattggatggtgaagttccgccatacatacgaccctcaagacatgggattgatagaatttcattacaatgagttagcacgacaatgtggcatccgcgttccagacttcaaactgatcaacggtaagtatttcacgacacgccgcttcgacatctcgcaagatggagaacgtttgcatacagtcacagccggagggctgcttaacattccactatccaacccaattctcgattatagcaacttactggccctaactggctatctaacgcagaatcctttagaagtggaagaaatgtttcgtcgtatggttttcaactatttcacagacaacaaagatgatcattgcaagaatttcagtttcacaatacagaaaagtgataccagcacatggcaatggcatcttgctcccgcctacgatctcaccctatgcacagagggttataatggtgaacatgcgacttcggtcaatggaaccggacatcccaccattcaagacatgataaccatcggtactaaaaacaagatgaataaaccgcactgcatacgaatcattgaagaggttaggactggctgcggagatttgttgcggaacaaagactgggagtaatttcgacaataggagctgccttccaatctatcagaccatccgccgtacgtaagtccataaaatcaaaatccataagccatcgtttcaatttctcttccgctccacgcaagccataatacgatttgaaacgacggatataatttaagtcctcaatcatcggttgctccgcatccagatcacgaggatggatgtaagccaacaaatattccggacattcacgtgtccatttcctcaataatctatagggaaccaagcggaaatagcctcctccagagaaaacgatatgctttcccaatatcttacgatacacgatcgggaattctttcatccttattccgttatattccacccagctaggcaccgcagaaacatatgatggcattcctccatgcgcatgatgcgcaggaaaaaccgagctatccatacgaattcccaattcatgcaatatctcgaaagcccacccctcgctctcacggatcgagaatcccggcgcacggaaagcctctaccttctgccccgttatatcctccagcaattttatggaagaagagacatcctctttgaatgcctccctcgattgctgccacaccaactgatgattcatcgtatggcttcccacttgatacttggatgcgatctgtcgcacgatatccggatacgtcttggcgatccagccgatcacgaaaaaagtagccttcgtatctgtctcctccaagatacgaaaaatgcgctccatattctcatagatacgcacttcaaaccttttccactgctcctcggagcgtgtagagtcgttatcgaggagatgaaaccactcctcgatgtcgaaagttagtatgttcataggaatttagaaacttacaacaaatcgtaattagacaggtttacctcccaatttcggatatcataaagtgaatcatcaaaaaaatctttcactaaaggcttacatgtaaaattgaaatgtttaggttccaaacgatgagggacagaaatcaagccaataggagtaaaaggcaaatttcccacgtaaataatcatgtctatccccttccgctctttcttatagatatatcggacagcttcttcaaatgcagatctcgaaagtggccatacatccaacaagaaagcggtctcaacttcattataacgttctaacttataaacaaattgagatcctttacgtgacacttttcgataatctcctccaaaccagcgataacgcaccttatcaaaagactcacgctctttatgatacttataggaatacaacctatgaccaatcgacaagaaagaacatgtgtacagtactcttgaaaagatccggctaaaaatattcaagaaagcaagtcttctttttactgctccgatattacggatcatgcaatagattgtcagtttacccacatcccgatgcttcaatcctttttttagtataggataagaattgtcattcgggaaaccgatcctcaatacacaaccgtcttctcttaactgtttttggcattggacgatcatatcgtgaaaactgaaataatcacgatacgcctttttcaccatcgagtcgataccaagcgcaaccataaaacgctcattgcctctttggtaatagaaaggcatgcaggaatggaaacctaccgtatctccctcctcattcaataatatactatggtaagaataccccaaaggtgtatttgaatagttctcacgaaacgtagccacatcacgtttctgcccaaacacctcctcgaaaagagcataaatcgctacgatctcttcattcgagagctcaaaagttttcttcactaatacttccatagtcccatcttattgagccgtatatcccccatctaccacgatattttgccctgtgatccagcgagaagcgtccgaaagaagaaataggcaagttcgagagatatcagttacttcacctacccccaaagggaatccacttatacgtttttcatagtcctccttggaaagagaggaaagaaaacgttccattaatggcgttcttactgtacccggtgatatacaatttatacaaatctttctaggggccaactccaatgccattgccttaaccgcactaaccatagcaccttttgatgccgcataagcagaaacaccaccccttcctacaatagacagaatagatgagatcaaaacgattcgtcctccattattaaaattctttcgactgctaaaacaacgtataaactcaaaagcacttaacgcattaaccgtaaatacacttttataatcatccgaagataaaaatttcaatggcaaagttttttctattccggccgcatgaacataggcatctatctttccatttgcggaaacaatattatccactaataatctaatctggtctatatcagacagatctatcgaataataacaatgcctctccggatactccatctgagctatcgtctccttcaaccgttcttcatcccgggcgatcaataccactatggcccccatcttgctacaatctatcgcacattgccgaccgataccggaagaagcacctgtcacgatgatcaatttatcttccaaagaaaatggattcatcatacttccactatatcacttattttacaatctacaaatggaacaatacccgtagcccacgtcatacccacaccgaaagcacttaacaacaacttcttgttaccataaagcctatctttcaactcacttacaattgtcaacggcaccgagacagatgacgtattaccatatttagcgatggtagacggtatcttatccgtatccagtttcattttcttagcgatataagcattgataaaattattcgcttgatgaaacacgatataatcaaatgagtccgcagtatcacccgcatattccaatgtcttttttatatcacgaggaatttcccggatcacgaagttaaaaacatccccgccttgcatatacccctgctcatcgctacgaatattgccatactcatccacgactttctctcgcaatgtctcctcagaactgggatgtcgatatcctccaccttttatcatgataagatctgcccgagagccatccgagttcaatgagaaataacttttcccaaacttctcatctcgctccaccaaggcagccaccccaccgtctccaaacaggaacgcactccgacgatccttgggcgagtaaacctttgaacgagtctctccatccaatatcaaggcttttcgaatccccccagattgcatcatgccatataccacggaaaggccataacaaaacgccgaacatcctaaagaaatatcaaaagccacacatgaatgagatagtttcagtcgatcttgaagaatgacagaagtagcaggcatccgataatccggagtctgggagataaataccaacaaatcaatttcctctttatttatcccattatcctctatcaatctctccgccgcagcaaaacacaaatccgaagaacatgtatcggcatcagcgaaacgacgttcatagatccctatcttatcaacaacctcctttacttgatcttccgggaagtattgagtatatttataattatcaaccacacaccgaggaaccgcagcggccattgccgttatacctactccctcgtaagtcaaaaatgccatctctcaatctattttacagccaaatcatacaaatctccaagtgtaacacacgctttcagctccttaccgccaacctctttttcaaactcctcatcgaacaaagcgataagagacaacaccgccaaagagctccactcatccaaatcgcgaaattccgtattctctgacaattttttcgtatcttctacttctatcgcttcagcgaacttctctataaaaacttgaatatccataatcttacttatataatttaaattttacgattccatttataccccaacaaaaaagacaataagctgccttaaataaagagacatgctccaccgtccttagcaccttccattgcgagaagatagtcttcctcttattagccgtcaccgccccttggcgcactctatacagaattgagactcccggattataatgcgcataaggtacatctttcaacatttcaagccaatatacatagtcatcacgcatgctgcccaatgcctcattgaaataatatttttcacactttgacaaatcatataccgtggccgatggacatatcggacataccttcaacagatccttataatcaaccctatcaggacggggaaaaggagagctgattttttcttttgtattctcatctatcctttgtacaccgccataagcgatcacgacatccttattgctcaaaaacaaaatttgggactccaaatactcttccggccacatatcatccgaatcaaggaacgctatgtactgtccttgcgcctctttcaacgcgatatttctcgctcccgaagatcccttatttatcttactttctatcaacttaatccggggatccgcatatcgcttcacgacgttgatccccgccccatcatcgggagaacaatcatccacgataatcatctcccagttcgtatatgtttgcttcaagacagattctatcgtgtctccaacaaattcagcccctttatacataggggtaatgatcgagaccaatcccttttccatatttatttgatttttatattataatcacactccgatcaaaagaccaacgaaccttgtcagccgattcttgtttctcacccttgcgtatagaaacccgataaccattggcaagccaaagcccatcacgatcgataccaacgacaacacatattgattcacttccggcaaggcatgggcgataggtccccgaatgaacatttgcggaaaataagacaacaagaacacggtataggtaaatcccgacaaccttatcattcgatctccacaatgcttctccaccgagagcgacaaggtcagactaaaagcaatgccgaccaaagcggccattacttttaccggaatcaagcctgccgataggacgaatgagcccaaaagcatagcacccctatagcgcgacagaatcgcatccacccttcccttgtagatacaataaagaatccccaagccgaaataaaccgaataatgaaccgcggacgatatttgcataaatgacagatcgggtatcacacggcttaacacaaatagcagaattaccccccccatttgtaaatatatgttaacgcatatccatttccttaaaagcgagaagaacacgaatatcatgaacaacgccggtaaaaaccacataaagccaatcggatgaaaaagcaaactctccacccacgaggagaaactaaacgtcaacggatgctgcatcaaatcggcagaaacaaaacgtgactttatgacgaaaatcacactattaatgaataagaatggcaataaaagccgcttgacctttttccatataaacgggaaaaatctcattcccttcatcttattctcagggtgtgtatatgcgaacaagaagccggacaccaaaaagaatagaggcatatgaaatgaatacacccatttatgaatccagagatctttgtaatccaaggttatatccgcatggcctatcacgaccaacaatgtcgcgaagacaaataaaaatgatacttgcgtgagtttattacccataatcattccatgtttagcacaatttctccgccaattccaacgcgctagcgatcacctgatgcatatcataatatttatattccgccagccggcccccaaagatcactttctcctgcccatcggccaacgccttgtatcgagcatacagatcgctgttccgtatatcgtttaccggataataaggctcatcccccggtctccactccttggaatactctcgtgagatcaccgtgtccggttgctgtccgaactcaaaatgtttatgttcgataatacgggtataaggagtatcggcatccgtatagttcaccacggcatttccttggaaattaggaactccttccaataactctgtttcgaaactcacggttcgatactccaagtgtccaaagcgataatcaaagaaacgatcaatctcccccgtgtagattacccggtccgctatcgaatcaaaatattctcgattttcgaaataatctgtatcaagacgtacttccacgccctctaacatccgctcgatcatcctcgtgtatccgccctccgggataccttgatatttatcgttgaaataattattatcgaaagtgaaacgcacaggaagtcgtttgatgataaacgcaggaagttccgtagatttacgcccccattgcttctcggtataatccttgattaacgtataataaatatccttccctatcaaagaaatcgcctgttcttctaaattctgcgggttaatgattccagattctttccgttgcttctctatcatctccttggccttctccggggtagtcactccccacatctgatagaaagtattcatattgaagggtaaattatacagttttcccttatattttgccactggagagttggtgtaccgattgaactccacaaaagagttcacgaactcccataccctcctgtcactggtatgaaagatatgcgccccgtacttatgcacgttgatgccattcacggactccgtatagacattaccgccaatgtgaggacgtttgtctataaccaaacatttatatcctttttgatgaaggaggtaggccattgtggttccaaagagaccagaaccgacgataaggtagttgtattgattcattatttaatgcatcctataattaaaaaagttcaaaactttcattgttacaaaaaggagaaacggagatttggagatagaatacatgattctatgttttcgcggtaaaaaaacagcaaaatcgccatattccaaataacaggtagaactcatgcaaaaattatacatcttacaatattgcggatattgaagccgttgagctatttgaagcaaattatacaaatttgattttagatatctcgctttatacaacttgtccaaaggctcattatagcaattatgctcctccataaaagatctagcagacaacaaggcaatattcatatcttggaataatttttcaaaagaagaacgcgatatactcccctccctctcccggatatcgaataagaccttatcaacaaacgaaattttctttgccaaacaagctatttgaatagagaagagagtgtcctcattcacaattccctccttaaataacaggccattctcatgtaaaaaatcacggcggtacaatttaccccaagccgaagtaggaaaagttttcactaataaggcattcggtagtatctcatccccggttaggctattaattccaaaagagctacgtcctcgtcttattgtacccatcgcggaaatatattgtgccaaacaacaactcacatcagaattattccgctgaatatcttggtatagctcttgaatgcaattcttctcaatccaatcgtcactgtctacaaataagacatagtctcctttagcaacctttagcccagcatttctcgcggcagacaatcctccatttctttgatctattaagatgacacgagaatctttcttctctatttgtttagcaatttcgcaagatccatccgtagagccgtcattgactaatattacctctatattattaaaagattgagacaaaatactattacaacacgtttgcaaataatcctctacgttgtagataggtactatgactgatactaaaggcatattcattgtttaataaacttataaatattatcgacagtagattgaacatcaaaatcaagacttttttcaacagcccgatttgagtaatactcccttaatgaattattagttatcattctcagcgtattcttcaagagagaatcatcatcttcttcagaaagtaagccatattctgaatcggccaatatctctttcgagccagagaccgcagttgcgataattggtttacccaaacacaatgcctcacaaattaccaaaggatagccttctgtcatagatgtactaagaaacaaatctgacgctgcaatataaggatatggattagatttgaatcccaaaaaatgaaccatatcttcaacactcaaatctcgagctagcctccttaattctgcttctaaataacctgtaccaagaatccaaaaatccacatctacattattctttttaaggtgatacgcaagacgtaccattctatcataagctttctgaggcattaaacgtcctacagagcaaattgtaaaacgattcttatctattacattcttctttgataataacactatattctctctatctattggattatatattgttgttagttgcccatcaacattaaacagtttaacaaaccccctttttgcatcatctgacacaaaagcgattttatccattcttttatatattgacctttcttctaagaatgaataaaaataatgatttgtataatgttttgtcaacagatctatatgaatccaactcacattagttctacctttattcaaaacataactatgaaatttcacagatattccttccataaaagatataataacatcataattttgttcaactactctatttattctatataattgaaaacaagatatattaaaatacttggctaaaacaaaatggagtttatacaacaagccatcattctcacaataaacacacttacgattaacaaatgaagggatttcatctaaataaactcctctattaataattagacacaaatctacgtcatacttcgaataatccgtatatttcaaaacatcaatcaataccttctctgctcctccaccagataaagatggcataataaacaatatcctattttttaacataactacaaacaatttgtcttagtttctcaaacgtactaaaccatattaagagtttaacaatttcaaacacacttcctctaacgataaatacagaatcagataccatcacagaataagcaataaagcaatatatactattaatagaattcgatttacaatattgcaagtatattccaaacagataaaagataacaacaactcctatcaagccaaaagataaatatatatcagataccatattcgtacctagacccaattcccctgccacagatccaaaagtaagataagaattaaaatccgcagatgtcaaattatgcaatccgacatcaaaaacatttacaataaaagattgagcaaatggtataaaagaaaatattccaagctgagttgagaaataggtatatccattatgttccgcataagaaatcaacgaatacaaatttctattattaataatcaaatccaagaataaatcaaaaggagattctataatatcactaaaatctaaaaaagaaattgaagaatcatatctgaaataagaaaaaaaagacaataatacaactcctattaccccaaaagcgaagagccacgaaagattaattttcctaatgcaatcattaaaccctatcaatagaagcaaaaggacacctaatggcatacctctatttccagctaatataaagcatatacacacagcaactattgtataaatatattttttacgtaacacatgcttatttttatacatttgaaacatatacataagaaatatcaacatcaaatatcttagagacataaccataatcctaatataaaatggcgttgatccaaaattatcattttcataggtatcttctatataatcaaaacctcctaaaaatgtatagcaaaagaaaagcaatagaattaaatagaataaggcatcaataaaactacaagtcacaaaccttgcattacaactcttcagcttaaacgccatttttctatcaacagataatacgcctaacaaatagcagttatatgcgcaaaaagctaccgaggtagcatatgatataacagactcatcaaattcaaatcgaaaaagagacacataagtattatccacataataaaagactggatatataaaattagcaaaaaggaaagaaagaaaaaaaacgccatgaaaagaaactacatcttccttataacaagtaaaataaagcagattctcgatcaaatacaaaaataatatacaagcacagaactcataagaaaaacacctaggagaaaagaacactaacaacacagataaaagcagaaaagcaaactttaacaaaagagcaaattccctcataccaaaatgatatatatatcaataaaaacaaccagcatttattcaaagtaagtctattggcctaaacaaatttacataaaactcataaaatctcttttctacaggcaaataaaatttcttcgcacccaacttttccttcaagctctttttaataccaacataattcaaatcttgtacatactcatccaaactatccaatgattcaatttctaaaataagagatgaaatatcactataatatggaaatttcatatttacataatactcatcataaagttttaagatatcagtaccatccaaatattttttctgcgaagagaatgcataatgaaccattatagaattaccaacaaagcaattagagcatcctaaacttgttggctttacaacagataagaactcctcatcatctccaacgacctctcctgaaaactcattaaacgatgatccaaaaaatgaaaccgcatttattgaaaatcgattcatcgctatttccttattagatatcataacatcttccacacaattactttttataatatcataaaaccatcgatgatacttttcagaaaatttaggagagcaccacccagccacatcctccatataagctttaagatagcgagagagttttagtttaccggaattatataaagcgtaagcacatagaccattatttataactatgggagaaacaagaaaatattcaggattatttatccgataatccaccaaagtacacaaagcattattatccatccatattatatcatcatccaattttaaataaatagattttggatctacacaatatttatagaaggcgtttatagaagctatgccatttatttttccatctggctgataaacaagatttaccttagaatatttattttctaattccttaaaaaatgcgatatccaatttactcattgtattaacccaaatatcatatcgatcgatcatatccgacttcaatatatgaggtattaagaacttcatatattgccttctacctgcagctgtaacagccactatattataaccatttctcataacacttacttttttgataataaaacaatttaaagaagaaattctttattaactatatagactttgctaaaatcaagagtaaaatcacatctttaagatttattctcctaaggcttgtaacgaaagcccacatatcttcctggattatcataattcaagactttcgctggtacacctgcaaccgtagcattctcaggaatatcacgtgtaattacagcaccggctccaatagtgctattattcccaatatgcacattttcaacaatacagacatgtggaccgatataaacattgtctccaataatagctggagtattttcattggttcctatatttaagaactgtgatatattgacattgttcccaataatagttccttcattgatcacaatacacatattatgccccatatataatccatacccaaccttagttccagggggaatctcaacatgcgacatccaagaggcaattttatacatcagtttacaaaaccaccaaaaccgccccttacgataagaggccatccgaaaccaaaacaacacattacgaccaagaggtaacagtccttttaaaattattttaattgcactatttacccccccgaaaacctatataaatcactactaatcaaacatatacaatctccataattctcaggcacaggaatactcaatgtactattatcaagatcaaaatattctattttcatgagtaaatatttttaagcatctacttgtttttgattagtttagtcgcaaaactaaagatctccaaaaagaggatatcccgcttgaaccataagaatccggcatacgagaaagctccgaccatcacgcttgccgtaatcaataaccagctattcgaaatcaaaaggctcaagccacaaagggcgaacgccatcaaaacggaggcatggagataattcaaataatcccgctcaaacaagcggatcgacaaatatctgcgtcctacgacgatttggataagcaacacgattaactcggctccaaaagtagagatggccgcaccaacggctcccagcgaagggatcagtaacaggttcaaaaggaaattcagcacggcccctcccaccgtactccaaatcacgatgctttccttacccatcggatagaggatctgtaaaccgatcacattgctcaacccgataaacaagatgatgggagccgtccaacaaagtacgggtaccgccgccaagaactcatccccacaaaaaattcgtatgacgggtattgccaaaacgatcaaacccacgatgcagggcagtgacaaacctacaaccaaacgataggatttgctcgtcactttcgagaaagcctccatctgaccggtctctatcagattggaacaacggggtaacaagacaacccccaaggaggcaaccacgctcaataccacatgcgacaacttattgcccgccgtataaaaacccacagcgtcatcgccccgcataaaaccaagcatcaccgtattcaaattcaagtaaatgctggtcaccaagttaaaaacaaaaatacgcaacgagggacgcaaatgcctccaaatacgtaactcagcccaagtgatggaatggaagggtatccacttacgcagatggatgaagtttatcaggttattacctaccgtagaacctaccaagacaaaggcatagatcaacagatcgtccttgtctctgacaaacaagaaaagccccaacgccgccaacatgcgaaagcacaaggcccgaatcgtgatgaacttaaagtcctcgaccgcctgatagaaccagttcacacccaagcttgtgaacaagatcgtcaggcttaacgcatagaatacgcctaactgagcggatatttgcggcacatagatacccaacacggcgaccgccacatacccgaacaaacagagaatgacgctcaacaacaatatctccaccgtgatccgatttcggatggctacatcatcccgatacttagccacctcccgaaccgcatacatcggtatgcctaagctggtcaacaagacaatataagcaacgatcgactgcaggaaattcacggcaccaattccttccggcagcaacacacgtgccgcgtatgggaatgtgatcaccgggaatacaattcccgtaaccgtattcaagaaattaagggcgacattcgtctttaaagatggcattcgataaatattttcgccaaactgttaatagtagtaagcactctatcgcttccatctaacctaatatcagcaaggttgaataataattgtaagcactcaatttagggcacacaccctcaaaagggcacgtacagtgtcctaaaccgagttctgtaaaaaattaattctgattttaacatgagccagtgccccatgtgattgcatcgggtatccagagttgtggtcgagtaaggtaagtactcactgcctgtccccaagttccctcaataaatcatttaaaatataatcgtcactcatcaaatgaagtccatacttgctatcatgcaacatagaacaagtacgcgtatcatagaagatggcaagcgcacgctccggggatatctgcaaacgctccgctagtcgcataataatccgggcgacctttctccaaagcacttgctctctcataccggcctcccttctcgtatatcattaagccgctcgctatcaacaaaacgtaaatacttatcgagcaacgactgactcaatatacatatttgattattaggtgaggtatatcgcaatttacccaatgcttgatcaaccgtgatattgccacttatataatcctccacggtatcgatcacacggcaaagtccaaatcttcccgccccacacacgccaagggttgctccaaccgaagtgttgtctcatgatatagaacaatcataactcacctcctttcgcacctccggacgcagcggcttcccagtttcgcaaggcctccacgacatcctccgctacattcctcagactttgggtgtgcatgacatcatagcaatccaacagcaagcgacgcaccaatcctaccttctccaagcgtctacgcatttccatcggagaaatacgcattttcttggcagaggcttctatggccatcaccgcaaaatggatcttatctcctatttctgcttgtcgagtatccatgagtcttatatttatccttctttatctacaaataaaatcacatttacgatttccccacacctatcccgataataattcttcacttaccgcagttgttcgctctctttccgttcccgattacgcttaatcagcccattcaagcctacatgcaatatactccagcaaaagaggttcaagaaaaacaaataggttatgtcaacacgccatgccaacgagctattaagcaggataaagaaagcggaaatcgcaatgatacaaaccatcaccatccgtacccgcatccccgtgcgcaacaacttatgatgaaagtgattcttatccggcaaaaacggattcttgtgctcacgcaggcgatgcaagaccacacggatcacgtccagcagcggaaccagtaccgtagagaaagcgatcaccatgtacgggttggacaatgtcggagagacctcgttcgtcacgctcatgtggatgatcaggaagctgatcacgtagcccagcgtaaggctgccggcatcccccatgaaaagcttatgtccacggttggcgttaccgaacacgttgtagcaccaaaagggcataaggatacccagcgtacagatcgccaacaaggcgtaaacatactgcccacgaagaaagaatatcacgctcaagaccgacaaggcgatataacacaggcccgagcccaagccgtcgataccatcaatcaagttaatggcatttgttatatataccacgataaacaccgtgaacggcacccctacccaaaccggcaccgagtaaataccgaacaagccaccaaacgagtcgaaccagttgcctgacagtaccaacagaaacgccgcagcaatctgcacggcgaacttatagcggtagcctacaccgaccagatcgtcgcaaacacccaccagataaagcagcgtcatgcccacgaacaggaacaggtactcataaagcatattgaatgacaagccggacacgttcacatcccaaaagtacagacgaaaaccgatcaccaggaacatcgacatcaggatcactggaaaaaaggacagcccacccagacgaggaaccggcatcgtatgtaccttacgggcgtccgggacatcatagagccgtttcttatgggaaatcaccaagatcctcgggatgatcaccatgccgagcgatacggcaaacaggaaaccgaataatagaaacaaagatgtttgcatgatcctaacgtataagattatttctttctttcatccatcttcccccgcatgtaagcgatataccgctccacggcttcatgggccagtcggcggaaccgatcctcgtcatccagatgttcccaaaggaggtccaacagacggacatagatgctgaaatgcatgtctataccttttttaaagcgttataggtactgccgcccatacctccggttacgcagacgatggatttggtcagcttggtgactttcagcagcgtgtcgatgtaatcacccagacggggaaagaattgttgtcggtacatatgtgataatcgtattaatttctctgaaatccgtacgtgtggggatacggcagtcccgatacctcccggtcgtgccacgaccggtaatcttccgcagggaaaacggggacggtcaatcgcttataatccggctcgtctatccgcaagatatgcttgcgggcgtacgaacgcagcgagcgatccgttacggacaccatcacgaccggaaacggatacccgaacaggcgcatcggcgtggtctcgctgtccgggaacgcacgacgcaactgataggccgaacgctcgaaggcaacccagtaaggccccgtacaatataggtgcatggaggtatggttcgcacgctcacgttccatgatctcgcacaaatggtcgttcagcaacgccaccaaacgaacgccggaaggaagggtagacatcaaatttgaattatgaattttggattatgatttaaactgtcaactgccacttctcaactgtcaactgattcgtggcccagccatctatcatagtcgcccagccggtggatcaaggataatttacttttcttaggcgagggatcgacttgccaaggatccactagctcgtgtgccatgcgacggtagagagcgttatccgtacagccgtacaaggtgaccagcaacagggcacgggattgcggtgctttcacgacaggcaataagccgcgcatcgtgtcgtgcaagcgaacgaaagcctcctcatcgcccgacagcttataggtcgggaggagcaacgcgcacagcttgcagcgcatcacgtctgtctccgcacgcaaagaggcatacccccgcagtacctcgccggccaatcgtcgatcctcctcgcagacactgccggaagcatggtaacgtcccaaggcctcgtgcaggccctccgacaggcggtcgttgtccagatgggtataaacgtgcttgctcttcgtgttcaactcgatcaactcgtactcacccgcctttacctcgaacaagggtacccacatgcaatccagtatgcgcgccatcacctccttatgaccgccgcccggctggatcaccacctcggcctccatcccggtaaaataaccggacgtgatgcgtacccgatcccccttcaacaagcgggtactctccggcacgtacaccgggagctcgttggagtaagcctccgccacccagcgcaaattcgccatctcctgatccaagaggtgcgggaaataggtcgtactcccggaagagacacggggaaggaaattatacaaggggagtgcctgcttcatgcggaagatttcctctaccgaagaacggataaacacgtagttgaacagcaaaggtcgcctcgtgttgaccagcttgccacccacctttcgcacctccacgtacgagggggcgaaatactcgaaaagagcctctccccgacgttcccgccgggaaagctccacgtccaagcctttggagggactgatccggtcacgccgtccacccgcggcggtaggaagcgtgagcacgtaccagcgcacggctttcaagtcatgacgcttgccggcctgtgtcaggccccccttcggacgatcgtttctcaaaatacacgtcggcatgattctcttttccctaagatatacgaggagttcccctctgattaaacgacaattcaaagccctgccaaacgtaccctatttacgcctaacacacagcactttaagttttcaaatatggcatttctgaaaattaccatacctagtgaatatttagctactcgggaagtagcgtaaaaggaggggaaaattacccagttgtagagacggagcacgctccgtctcccatcgtctgacggtaatttaaataccattttgaggagatgagacggggcacgccccgtctctacagggatacacacaggttatgaggcatggtggaatgataccgggaacaaggggtcgtttcacccgcgtcaccatgtctatacgtttaggataaaatgggaaaatcaaagaatagagaggatcaaacgcctagaatgagaaaacaagcggatctattcgcttgtttttagttattttttactacattcgcggcatgaaagaatacgctacttcccgagtagccaatctcttaccccacctcggataccgatttatacacgctctcgaagcaagcccggttcaccgccgacagacgttccaaggaaaagctcttcaagtaaatttgcgtggtcttgatagacgtatgccccaacagctcgctgatcatctcgatcggtacgtcctgttccttcaaggtcgtggcgaaagagtgacggatcgtgtacgaggtgaccggctcacccacaccacaagtctccgccagcgacctcaagtcgcggttaaagcgcagcaaggcgccgttgtattccgcataggccgcctcacccgttttcttcccgctcagaaacgggaacaggtaaggcgagtccttgtccgtgcaaaccgccaactcatccaacaagagccgtacatcggccgggatctccacccggatgaaagacccgctcttctgacgatggtacgacaagaccccgtccttgacattctctttccgcaaatgggcgaaatccacgaacgccatcccgctgaacgagaacatcaggcaaaaacacagctgggttctccgcatctccggctcaactctcggagtccccatcaacgagcgcaagcaatccaaaggcaacgccttcttccgcttgctctccacgccagtaaacacccccttgaacagattcgggatatacgaaacctcgccagcctccaccgccaagttatagatatgccggattcgccgcatataggtggacaccgtattgcgcatacagccccgcttcgacagccatgcctgataaagcaagagcctctctttgtctatataggcataagggatttcctccatcccgcaaaaacacttgaacgagcgtaaagcgtccagataactcttcgccgtggaataacgccccacctcacgaaggtgggctatataagccaacatacccgccaccacgtcttcttttttcatataaatcctccttaaatccttgtttattctgttatcttttatttaatcatgtcaacaccattaacattgggacgaactgttcgtcccgcactttattttattaatccgaccttcaccgccgttaatctaagaaaaagaatacatgaaaaatgaatttaaaatgtcccttttcgcagccccgatctcaccggtcaaagatagcctaacgggacgagtatcacgaccggctaccgtatatcccagtcgagaagtcaccttacaggaggtggcccgactcatcaccggcgatccgaccctcgaacgcctcacccggcagctccgcctcccgcttgagacgggtgacaaggaacgattcagcgagctgaaacggcaaacgctaccgtatgtcacgccttgcgggactttctcctaccggaaaagcgatcggctcctggccccgagcggattggtggtagtggatgtagacggattggactctaccgcggaggcggaagccctccgaagacagctgttcgacgatgcctacctatgccccgctctctgcttcatcagcccgagcgaacgaggcgtaaaggctttcgtcccctatccggaacatcccggaaacgagacacccgcctatatctccgagcatatcctaggcgtaatgaactacgtggaatatgtgtatggcgacggagagacgcgaggctcccagaaagtagacccgagcggcaaagacatcgtccgctcttgtttcctatgtcatgatcccaacgcactttttaggatttgaaatctaactcataaatcataaattacatgtcagacagtttatcccgcttagtagaagcggttcgttcggcgggtgtagatatcgcccccggatattgtgaatacgtgcgcttggcgtttgccatcgccaacgattgcggcgaggcaggacgagaagggttcatcgccctgtgttccctatcggtgaagtttaaccgggagaaggccgaacggcttttctccaacgccttgaaaaagggagaccacaggatacacctcggtacggccttccacttggccgaactggcgggcgtacgcctggagcctccaagccgcccccgcgatacgcacgcaaataatgcaagtaatgcaagtaatgcagcacctttttcccacacacgtgcgcgcgataataacgtagagatcgagatcgaggagcaggtcgatccgttcacccacctgcccttcttccccgaggggcatgagtggccccggatgttgcggcagatcatggcgttcggacagagccgggagcaacgggacgtactcctcctcggcgggctcaccaccttgggcgcctcgctcgcccagacgctgcggttcctatatggaggcaaatggttcttctccagtttgcaaaccttcatcgtcgctcccccgcctccggaaaaggcgtgctcgcatggacgcgaatgctcgtgcaaccgatccacgacgagatccgggcgaccgtggcggaggagatgaaaaggtataagaaagagatgacctccttcaattccttgggacgggaaaaggcgaaagccgaggaaccggaaatgcctctcaaccgtatgtttatattctccggcaacaacaccggtaccggtatcttgcagaatatcatcgactcgggcggcgtggggatcatctgcgagaccgaggcggacatggtcagcaactccatcgcctcggattatggccattggagcgaggtgatccgcagctcgttcgatcacgacccgctcagttacaaccggcggacagaccgggagtatcgggagctgcggcactcccacctgtcggtattgataagcgggacgcccgggcaggtgaagccgctgatcccttccagcgagaacggattgttctcccggcaaatgttctattatatgccccgtgtacttcactggatcaaccagttcagtctacagcggaccgacacgtcgctggaattccagaaattgggcaaggactggatcgttcacttgagagagatccagaaactgggggtgatctcgcttcgcttgaccgacgcgcaaatcgcctccttcaacgaggtgttccaaaccttgttcgagcgctcccggaagggcaccggcaacgagatgaacagctccgtcgtacggatggccatcaatatcggacgtatcctgtcgatcgtcgccctattgcgaataacaggggaatgcgaggaggcgggagacttcgccgccagcctgcgcaagtcgccccggctcacaccagacccgcagacctgcgccgacaacatcaaggacgggatcatcacccgctgggatctctccatccaagaggatgatttccaagcggtcctttccttggccgagcctatgtacctacacgccgtacacatactctcgttccttcccgccaacgaggtgaagaaccggggcatggccgaccaagaacgtctcttcatcaccttggatacggagttcacctatcaatccctcttggaagaagccgagaagctgaagatacccaaaaacaccgcatgcagttgcttgcaacgttggcagaaacagggaatcgtccgaaagggagaaaaacgaggggattataagaaaacataatcccttttcctcctcttcttttaagtatgtacgcacgtgtgtgggaaaacaggtactgcattacttgcattatttgcattactcgcacgccccacacgtacaccggcatcgcctcacgcctacgcccgcatagggccacggcgatatacgtgtgggctaacgtcaatatacacatgaagcgatgccgatatacgcatgcgaaagcgaacgtggaagatcctcgttcaaggacggcccaaatagcgaaagatcagttccacttgcagggaggtgaaaatccgctgccggttttggtagcctgtctcatccagctcatggctgagcttctgatgatgtcggacccatcccgccaagcggttgagagcggaactcggactgatatcgggagcataggccatggccaactcccgtttgctataagggcgcaccggccactcatccagatattcgttgtttgtttgcataaaataggtatttttcaattcatttacaggaataaagatactgaaaaagtacgaatccggcaacgatccgatccactaatattcatcttttatcaccttattcccctcgatttcacaccgcctctacgagactcattccggaggaaaccggaagtcgtacattcgtaatcgaaaacagatcgatcccattttcaattatcaattatcaatttttaattatcaaaactatggcattaaattacagtgtggcccttcggcccaaccccttgaagaaagacgagccggcgaaagcgtacgccacggcacagatcaatggagagctgtcgctcaagcaactgagtcgccggatatccaagcaaaccaccgtcagccgtgcggacgtggtggcggtattgatctccaccgtcgagaacctgctcgatgccctccaagagggaaagcaggtggatttcggcgagttgggcaaattccgtctacagatcctcaacgagggggcggagagtcttgagaaattcacatctacaaacatcaccggtgtcaacatccagtatataccgggcgaggacctgaagaacatcttcgccggactggagttccagccggtggccagccgcaaggctcagcaagccgtgcttcgtgcggagaaggccggggagacctctgtagatatcagtaagaagcccgcttccggaggggacgactcggaatcgcctgacgagatatagcgtgtcacttttggcttgacccaatcggtatgtcacttttggcttgacccaaaagtaaccaaaaggtcaaggctgacgctgacgggctacttcgagacctgcgctcgctgtcgcatcccaactcgctgcgctcaaacagggatgctccgggcgctcgctacggtctctccgcttcacgcccgtccgctgaggccgtccgaaggaaagcgtcgctttcctcttatatcagccgggatatcattattcattattcattgttcactattaattattaattatcatgaagaagtctgtttggagtaccattctcaaagtgatcatcgctgttgctaccgccatcgcaggggccttcggcctgcaagcttgccaattgttttagcaagcctcccccacccgttcccactccctaaagaagacaacctccccaaaagaggacaccctctacccagaaggacagtctttctcaaggggccggcctctcctcaaagagccgggaacggctctccatccggccttagcgggcgggcgtaaagcgaggcggccgaagtgagcgacaggagcgtccctgtttgagcgaagcgagttgggacgcgacagcgagcgaaggccgacgagtagcccgtccgcgtcagccttgaacttttggttacttttctttcaagagaaaagtaacacacaaacaaaaaaaagaataaaaatgaaacaatattgcttttaccagaattacagggaggttcgcctccttgtaattcattgcagcgcaacacgctacgaccgggattttccagtggaagcgcttcggagcgcacacaaggatcgtgggttcgccgacatcggctatcattactatatcacccgggatggcgagctgcaccgctgccggccggagaaccagatcggggcacacgcctcgggctggaacgatcacagtctgggtatttgctacgagggcggattggatgagcgaggtcttcccgctgatacccgcacctacgcccagcgttgtaccctgctcgatctcttgcggcagctacgccgtgattacccgtcagcgcatatcctgggacattaccaactcagcccctatatccgcaaggcttgcccctgcttcgacgcggagaaagaatatacggaattgtattaggcttcgtgatatttgaataggcaacagattttttcgtatgtttgcggacaatatagaaaataaacaaaaagatacgacatgaactactacgaacttagtttcacatacacctctcctatcgagaaagagattatcaatgacgtgctggccgccgagttgggggaaatcggttttgagagctttacggaaagcgagaagggtttgctgggatatatatccgaggctttatacgacaaaaagacattggatgataaactggccgactttccgctagagaatacccggatcgattacacctccaaatgggtagaaagcaaggactggaatgaggaatgggagaagaattatttcaaacccatccggatcggaaacgagtgcattatccgtgcctccttccacgaggcggagcccggctatacatataatataataatagacccgaaaatggctttcggtaccggcaatcacgaaacgacttatttgatgataagcgagatgctgaaactagacctagaaggcaaggagttactggatataggatgcggcacagccgtgctggccatcttggcccggctgaaaggggcgaaacgggtagcggccatcgacatcgacgaatgggcttataacaacgccctagaaaatatccgcctgaatcataccgaagacatacaagttgccttgggcggcgccgagaaaatcaaggaattcgggcaattcgacatcgtcttcgccaatatcaaccggaacatcctcctgaatgacatttgtcaatatacaaacagtatgaaaccgggaagcatcctatttatgagcggcttttatgtagaagatatcccggcgatagaagcagaatgtcagaagaacgggctgaaattggattcttataacgaaagaaataactgggttgccgtgaaggtcttaaaaggataactttttttaacaacaaaagttaagacaaagataaaccttaatccaaataaatacgttatcttagtggaaacttctaaaaagaaaaagttatgaaaagcgtagattcaaaattattacttggccttgtagtaggtgcggctgttggtgccgctgtaggttatttggcagcgacagataagagagaacaattactggaagaattgaacggtgttgtcggaaaagtaaaagaaggttttaactccgctcttgccaaatataaagaaggaaagcaagaagtagtacaggcaacagaagaaatcgtagctgaataagctttgtatggagaaagattcaggaacagtcttccgtgagctgaaagaagatgtatcggcttatgtggagttaaaacttgagctcctaaagttgagcacatatgagagaacgggtaaagtcatagccgttctctcatatggcttgatattattgttcttggcgttcttcgccatcttgttcatattcttggccttgggcttcttcctaggggattggctcggctcctccgggttcggattcggtatcgtggcggtcttgtacctgctacttatcggcattataataatgaatagggacaggatcagcacaaaagtattaaatgaggtaatagccgccatgacggcgaatgacgataaaaataacgcgacaaacgatgaacaaccggcaaaccccactggagaaactgatttctgacaaagaacgcatacagagacaatgtaagcgacaggaacagaaattgaatgaggatttctcttatatacaggagaacgccggaagtttattgttatccggattatcgtctctccttttcccgagcaataagtcaacgacaaaaacaaacgacaagaacacagctcccgtaacggctggacaaccctccatcgctttagggatctcagactatttatccatagcgaaaggcatgattcccatcgcttgggatctcgctcaaccatttattatgacgtggggaatcaaaaaagcgaaaaaatggttctctaatctcttattcaagaaaaagaaataacctccaacaattaatttatgttagagggcagcttttttctggctatattataaggctcaatacaaaaaacatgactacatttgcagtcgttaaagcaaggataaaatgaatatctactccttgcgatggataagagataaaaataaagacttattattaataaacccataaaaagttttattacaatgatcaaactaggtattaacggttttggccgtatcggacgtatggtgttccgtgctgcagttgctaactttggcaacgacattcaagttgtaggtatcaacgaccttttggatgctgattacttggcatacatgttgaaatatgactcagtacacggtcgtttcgacggcgaagtagctgtagaagacggcgctttggttgtaaacggtaacaagatccgtttaactgctgagatggatcctgctaacttgaaatggaacgaggttgacgctgacgttgttgttgagtctactggtttcttcttgacagacgagacagctcgcaaacacatccaagctggcgctaagaaagttatcatgtctgctccttctaaggacgctactcctatgttcgtttacggtgttaaccatacaacttacgcaggtcaagacattatctctaacgcttcttgtactacaaactgcttggctcctatcgctaaggttttgaacgacaagttcggtatcgttaaaggtttgatgacgacagttcacgctgctacagctactcagaagactgtagacggtccttctaagaaagactggagaggtggtcgtggtatccttgagaacatcatcccttcttcaacgggtgccgctaaggctgtaggtaaagtattacctgtattgaacggcaaattgacaggtatggctttccgtgtaccgacttctgatgtttctgttgttgacttgacagtagttcttgagaaagaggcttctatggctgacatctgcgctgcaatgaaggaggcttctgaaggcgaattgaaaggtgttcttggttatactgaagacgcagttgtttcaactgacttccgtggctgtgctaacacttctatcttcgacgctaaagctggtatctctttggattctaacttcgctaagatcgtatcttggtacgacaacgagtggggttattcaaacaaagtttgtgagatggctcgcgttatcgctggtaagtaatttattaccactctacatagaaaaggctatcctctttgaggatggccttttttttcgtacgtttgtatcatgaaatcatatgaacttatcacgattctagggcctacggcttccggaaagacgaccttcgccgccgctctcgccgcccagttggatacggagatcatcagcgctgattcccggcagatctatcgttctatggatatcgggacgggtaaggatttggccgattacaacgtgaatggaaaacaaatcccctatcacttgatcgatatctgcgagcccggctataaatataacgtatttgagtatcagcatgactttttccgggtctatgaggatatgaagcggaggggtaaactcccgatcttatgtggaggaaccgggatgtacatagaggccgtactaaaaggatataagctattagacgtgcctcaaaatcctgagctaagggaatccttgaggaataaaaccttggaggaactggaaaccatcctcgcctcttataagatattacataataaaacggacgtggacaccgcccagcgggctatccgtgcgatcgagatcgaggagtattataagactcaggcaccagacgtaaatgaatataatccgatcaacagcctgatcatcggtatccacatcgaccgggaattacgtagggaaaaaatatccagacgcttgcggacccggttggacgaaggaatggtggatgaggttcgtacgatcttggctacgggtgttaaaccggaagacttgatctattacggattggaatataagtttcttactttatatattatcggggagctttcttttgaggagatggtctcgcaactcgagatagcgatccatcaattcgccaagaggcaaatgacttggttccggggcatggagcgccggggttgcgagattcattggatagacgccactctaccgaccgaagaaaaaatagcgacaacaatgcgaattctaaataatcagctatgataacaataaacgatctaaataaaagcgagaacttcttcttgatggcaggtccttgcgtaatcgagggggaagatatggcgttacgtatcgccgagaaaatagtgggtatcacggaaagactgcatataccctatgtattcaaaggctcctatcggaaagcgaatcgctcccgtctggattctttcacgggcatcggggatgagaaggcgttaaagatcttacggaaggtgagcgagacgttcgatattcccaccgttaccgacatccatgagacaacggaagctgccatggccgccgaatatgtcgatgtccttcaaatcccggctttcctatgccgccaaacggatttattggtagcggcggccgagaccgggaagatcgtcaatataaagaaaggacagttcctttcgccgggtgccatgcaattcgccgtacaaaaggtagtggacgcaggaaatgataatgtcatgatcaccgagcggggaacgacattcggctataccgaccttgttgtcgatttccggggtatcccgcaaatgcaaacattcggtttcccagtcattatggatgtaacccattccttgcaacagccgaaccaaacctccggcgtgaccggtggattgcccgcccttatcgagacgatagcgaaagccgctatagccataggcacggacggcctgtttatagagacccacccggagccaagccaagccaaatccgacggggccaatatgctcagactggatttattagaagatcttttgacacgtttggtacgtttacgccaagcgatcctataaaaaataaggggcccttactaaaaaggcccctttatttcttatttttacgatcaataatctaattatcccatcttgctgattttcttcaaccgatcttcatctatcaacttaatctttctaccgtctaaagcaatgatacgttccgccacaaaggtagacaacgtgcgaatagcattcgatgtagtcatattagatagatttgccagatcttcacgagccaaatagatgcttaacgtagcaccgtcttcttccagtccgtaactatctttcaggaataacaaagattcagctaatcgcccacgaatatgtttttgcgtaaggttaaccgtacgttcatccgagataccgagatcaatggataattgtcggatgaaaaacatagccaaattcggattactcattaaaaggcccgtaaccactgtcataggaatcatgcaaaccgtagaagcctcgaatgcggaagcgttcgtcaagtaatcttcttgagcgaaactagcccggtaaccaaaatactgcacaggcttaatcattcggataatctggcttctgccacctactccatccttgtaaatcttcactttaccctttaacaagcacatcatgtcctttggttcgtcgccctcgcaataaatcaactcgttacgtttgaaatgctggatcgtcgaattactacggaggatctcacgttccttatcggtcagaaccctccacacctctgataaactggccgataaatcgacctcttctttttgctgtttaaccacgactgctatataacatacttatgaagcatcaaatatacgatttttcttttgataaaataaaaacttttgtacgattaattacaccatattgtaacattttactttctttcacgtctaaactgaaatttattcattatgtttgtctggaaagaatgtaaaatcgttgaaaaagttatattcgatacttaccttgattttaatctctataagtattttcgcgaagagcactgatacttatagtgataagatcctgtcttttggcaaggggaatcgagaaacgagagaacgggcggactcgatcatgcaccttgttatcgaaaaggcaacccaataccaaaatacggtatcgaaatatgaggctgagatctatatcaaaggacgtacagaaattttaaaacaaaatatgttaatacgtctcgcccaccatatcttccctatcgaccgaaaaaataaggatatgctttttgagatggtcagccaatctaaatttaacgctccgcagaactatcttcatgatctaaaggcggtcaacggaaacagcatacccaacgggaaaaagcagcaggaggccttggccttcttgaatttgaacgtatactcccctaccgcttacgatgatgctatcttcatgccgatagctagcaacgcttttaagttttatacgttcaatttggaagggctggaaactatcaacggcttgacgatttacaaaatccgtttcctgccgaagcaatggagccagaaattggtatgcggggatttatatgtcatcgaccagtcatggacgatcgataagatcgatatgaacggtcgttactctttcgccgaattcaacctagtcatgagctacggacgggatttcaggcggttcatcctgcccgagaaggcggatctattcctccgatacagggtattgggaaacgcagtggcaaccacctaccattcttcctttaagtatcaggaagtggaatgggtggaggaggacaacgaaagccataaatggaaatccttggacctgaccaattattacaagctctcgtccgatacggttcctattatcagggattccacgtattggaatatccatcgtgacaatcccttgagtccggatgaagcccacttatacaataaagcccaagagcagaatataaataaaatcgatacggccgatgatctccagaagtacgttaaactaacggagcagttaacgaatacggtcaatatggattataaaacgacccgtattaaatattccgggcttctgaatccattccaattgggttattccgcccgtaacggcatcacttacaaacagcgattccgtatcagcaagacatttacccgtgacaagcaaattcgttttcgtccggagataggttacgtattcaagcgcaagcagatatttttcaaggttggaggcgattgggaatactcgccgcagaaacggggaattttatcggtagaagtaggaaacagtaatgaaagctattcctccgagatcacccaaaagatcaatgaggaactaaaggattccaccttcaattttgatgatttaaaccttgagtatttcaaacactactatgcggaaataaaaaactccattgagttattcaatgggtttcaattaacaacaggcatctcttaccatcgccgtatcccctctaaaaagaaagtggcgattgatcccggggatgatgtagaggaaatacttagccaaaattataatgactttacgcccacgctcggtttctcctataccccccgccaatattatcgcatggacggataccggaaggagtatgtctattcgtattatcccacgatatcaatcgaaatagcgagaggtatccccggagtcgggaaaagctcgggagattacggacgtatagaggcggacgtgcatcaaagccttatgcttggcctatgcagacgattgaactatcatatcagcgccggtctttatacgcaacagaagtctacctatttcgcagactttaggtatttcacccgcaggaatttccccgatacatgggatgatcagatcggcggagtcttcaatctgctgaaaggcgagtggttcaatgcctccgataagtatatacaagcgcatttcatgtatgaaagcccttttgtcttattcaagatcctccgcatcaactccacgaaaaaattcatgcaaacggcctcacgctatatcctctccgaacgcttttatctgagccagctatggacaccggtcttgcctagctatacggaagtcggatacgggatcgggaaccatatctttaatatcgggatattcgccggattcgatcgctggcattaccaaagcatgggattcaagtttgccttcgagttatttcaataaatcgatagtgggcgggctaccaatatccctttacagctctttatcccctcggcgtaatctcgtaaggaggatacttggatgattacctttttagcggaaaaagaggcatggataaatgtcagttgtccatccttccaataggcgatcccgacatgcgtcacgtccagccccttgatagaagtaacaaaacagaggatatcgccattcttgattccggacgaacatttctcgatctcctgtttaggcacataataatgaggacgcaggtttatctccttttccttatcggccatccttcgaaccctttccggatggttcttcaattgcttatagctatccggatgcgtggatataaaagataaatccaaaggtagggaggcaccaccgatctcccgccccatatctttcacgattccttttcgctcgttctcatagaaccagtcggtcatataatgcaaacgatccgtgtaatcatggatcgtgccgtctctgtaccggagctgctgtaaattctcacagaagttctcaaaggtaggattttcttcccacagggtgcgggataaagccaatacgctctccgcgaatgtggtacaatccagttcccgcagattaaccaccaagccctccggctccttttccaaggtagaggcgacataaggagtccccggaagaaaagggcggtatggatcattagcttgtctaggggtaacgacttcttaggttccatctgagtacaataccgatcgaaaatagcacgatcctcatccgtacaatacaacttacgggatgtatgctcttgggcgttcactaaaaacaccatacatacacacatccaaaaaccgagcagtagcattccccttctcataagctaatcctttttcgttttcagtaaatcctccaatttcaccagctcgtcacggaattgggcagcctcgatgaaatccagtttcttcgccgcctctgtcatctgtttgcgagtccgctcgatcgccttctcaagctgcgtacggttcatgtattgcacgaccgggtccgctaccaagcttggttccggctctatataagcgtaaggctccgccgtttgttgtttctcggcaagcatggatacactgtttttcatgacttgcttcggagtaatgccatgcgcctcgttataagccatctgtttctcccgccggcgattggtctcgtccatggtctgctgcatactcgccgtgatcttatcggcatagaagataacctttccattcacgtttcgggcggcacgtccagctgtctgcgtcaaggatcggtgggaacgcaaaaagccttccttatccgcatccaagatagcgaccaacgagacttccggtaaatccagcccctcgcgtagcagattgacaccgatcagcacatcaaacaggccattccgcaggtcgtccataatctgtacacgttccaaggtatctacatcgctatgtatatagttgcatcgtacccccatgcgggtcatatacgtagtcagctcttccgccatacgcttggtcaaggtagtcaccaagactcgttcgtcttttgccgagcgctgcgtgatctcctccatcaagtcgtcgatttggtttaatgaaggacggacatcgataatcgggtccagcaggcctgtcggacgtatcacctgctccaccaccactccctcgctctttatcaactcgtaatcagcgggagtagcgctcacgtaaatgcccagaggcgtcaacgactcgaactcatcaaaggtaagcggacggttatccatcgccgagggcaaacggaaaccatactccaccaagtttttcttccgggcataatccccgccatacatcgcacgaatctgcgggatcgtcacatggctctcgtctacgacaagcaggaagtctttcgggaaataatccaacaggcagaaagggcgatcacccgccgcgcgtccgtcgaaataacgggaatagttctcgatacccgagcaatgccctagctcccggatcatttccagatcaaacgtgacacgctcatacaggcgtttcgcctcgaagggcttaccgatctccttgaggaaattcacctgcgttcccagatccacatcgatctgaccgatcgccatattgatacgctcttgggtggtcacgaataaattggtaggataaatattcagctcatcttgctcatcatactcctcgcctgtcaacggattgaaagaggagatgcggtctatctcatcatcccagaactcgatacggtacgccatgccgtcgaaggtctcgatcgccgggaaaatatccaccgtatcaccattcacacggaaacagccgcttttgaactccagcttattattcacgtacaaggcgtctacaaaccggcgcaacagcttatcccggtcgatacgcataccccgttccagatgcgtcactttctcggcgaatgccgtaggatccgccataccatataagcaggatacggatgagaccacgatcacgtccttacgacccgacaataaggaagccgtggccctcaaacgcagcttatcgatctcctcattgatcgccaaatctttctctatataggtatcggtagaaggtagataggcctccggctgataataatcataataagagacaaagtactctaccgcattatttgggaaaaacgctttaaactcactgtataactgagcggcaagcgtcttattatggctgagtatcaaggttggtctctgaacttcctttatcacgttagcgatcgtaaacgtcttaccagaaccggtaacacctaaaagtgtttgaaaaggaacgccgctcttgatcccttccgacaatgccgcaatcgcctcgggttggtcacccgtgggactgaacgaagacgatatttcaaaattcattctttatccgatctgttgtttaggcattattaaccataatataatgtagagcagtataccgaatccggcgaaaagaaccatcaatacccatacgatccgtacgatcgtcggatcgatatccaagtattccgcaagaccggcacaaacaccccctatcatcttattattcgaacgagtcaatcttttcttctcttccattatcctctattttaacaattagacagtatacacgcaaagataattttttccctctaataaaataacaactcctgtcgataattcttacaaatacgacaatgcccattgcaggctctttataatgggcattataaagcacttacaatgggcattcaacaccgcttacaatcgtgattaagcggcctatcgatccagcaactcttgcaaatatttacgagtttggatcacataatcatggcgggtaccattcagctcacattcaattgttatcgcacccttgaatccttgttttttcaactcggcaatcactgcgggaaaatctacatcgcccgtagggatcggtacctcatggcccagctcatacggattgttaggatccggatacttgccatccttcgcatggaactctttaatcaagttaccaaacaacttgaccgcatccagggagttcgacttgccatacattagtaaattcgccaaatcacaattgataaacaaattacccgtaccgatatcccggatcgcacgaatcaaagtgattggtgtctcctgcccagtctcgaaataaatcaagacattacgctccttcgcataagtagccaagccacgcatcacctcaatgaaatccttatactgcgccgaagacggatcctctggaataaatccaaaatgcgagtgcatagccggaataccagcctgtacacaaaaatcgatcattttacggtataagtccaacttctcgaaacgctcatcgataggtaccaggccgatcgtagccggtccttgacgaaaattccacgtacttttacttcccggcacaccaaccaacgtagttacccggatccggtgcttctcggaagcggccttcacctgctccgccaattccttcgtgaatcttttttcactataatttaactcacaagaaccaaagccctgctcatgcagggctttgaaactcttatctatatcgcgtacatcatattggatgacaccgatcgtgatctgttcctgcgccttcacgcccggacaaatcaaggccatagccaccacgtacgcccatatatatttcctaatgttcatattccttattattcaatctaagaatcaatcaattattgttccatagtcggattgaacgtacctccccaattattattctgctccaaattcgggttctcgtccaagtaagttttcttgatcgggaagaaatagaagctttcctcgatcacgaactggcgctcagctgcctccgtataaggaacttgatggattacgtagcgaaaatcaccggtagtcaactcattcttggcgatccggtcgcgagcgacgttcaagtccatatccgagccatccgggttgactgcgatcgcctcgataccatgtttcgtccaaccggccaacatcatcatattacgcgtacggcgcaagtcccagaaacgatgtccctcatagcacagctcgatatgacgttcatccaaaatcgcctgacggatctcctcacggctaccaaccttcaagccatacaaaccatccgcccctgcctctatacccgcacgcttacggatctgtttcaacaaatcgatagctacatcagaatgtccgttctcattagcggcctccgcatagatgaacatcacttcggcaaagcgcatcaagatataatcaatatcgaacgtcatcaccttgtcttgtgtcaaggaaagatcagacactttgtaattatacattccagagaaaatatcattgttggccgcattgacacccgcattcggattgacaccatattgatcgtctgcgttgctcacacccaaggcgttatacatacggttgtcggcagatctaccagctaccggccattcgcgtccgttatacaaacaagccctgttgaaacgcggatcgcgattcttccagaaagccttcagcaaagcctgctcgtcacctacgtaatacttgcccgtaggatcgtcgtaacgcttaccatccaacatcgggaaatcctttacgaattcccaagtaggattatgataaggtttatcacggctcacagaagccggacgcgtaccatactcccaagtagcgacacggttcggatttgaataaataaccgggaagataacctccggacctctttcttgcaaccaaatatccgccggattctctgtcaacgcgatgccattctgcacacaaaaatcatacgcctccttagccgccacgtaagcctctttccagtatgcgttatcatacatacgtttcggattgaactgaggagaagctttcagtaacaaggtctttgctttccaagactttgcaaaacactggtctatacgcccataatcactggaactaccagctattttggcaggcaacaaggaaatcgcatgatccaaatcctctatcataaactggaaacattccggcgtagagttacgtttcacgtacaaatcatccttatctttatcttgcggcactttcaaataaggtacgccaccatgatgcaacaccatccaataatacatataggcacgcatgaaataggcttgtcccaacatgaaatccacagctttcttatcctctatcacgctagactccagtttaaagatcgcctcattgatgtggcggatcttggtatagtcccattttttataactatccccagtctccgtgatcgtacccaaataccaaggaatgcccgtcacttgatccgaattttggtcggcagaaacactccagccctcaaaacactcctcatacagattgttcacgtacgcctgagccaggttaaggtctccccaaaccatagactcatcgtaggtctctaggttgtcgatatccaacgtgtcacagcctgttgtcattccacctaacagaaaggccgcactaattatcgcgtatttaaattgaatcattttcatatcttcctatattatatttagaatgagaaattaagaccaaaagagaacgttctcatcaaaggataagaatcataatattcttgttccggatccaagaactcggtcacagctgaaatacagaacaagttagtagcattcgcaaatacctgagcatgcgtgattcctaacggacgaagaatagccataggcaaatcgtaaccaatatttagattcttcaaacgcaaataagcgccattgcgcatccagtaactcgtattacccgctccagactcataccaactcgtgcccgtgatacgtggataaaccccatccggattaagttccggatcatacaccttatcactcgtccaaatcgggaaataaggacgaatcgtaccaccatgttgatagaaacctccatctacgccacctacgaagcgatcatattttccgaccccttgaaaatgcacatccagcgtgattcccttccacttgatactaccgccaaaaccataattgatacgtggcgtaccattctcactcaacaaattatactcatcattgctatcaatacgtccgtccggtccctccgagtagccatcgcctctcgtatccttatacaagataccacccagataaggatcccgtccgaattgcttgaaacctttcgccttcaaggcttccacctctgccggatccgtcagcaagtgatcggcgatcaggcccgtcaagattccctcagccttaccctgttttgacaacgcatgcaggttacccccttctcgataagtggcatcctcatccaatacatcccaacgatcacgagcgaatcccagattcaagtaggcagagtaagtaatctcgccattcgcggccttatccatccaagtcagagccaactcaccgcctcgccaagaacgctcggcatagttttccggagccaaagcctgtccgtacgtgcttgggagtgtcaccgtacgcggtccgaggatatctacctctttccgataaaaggcatcgaacgttccagacaaacgattattgaagaaaccaaaatccaaaccaccattataagtagttgaggttgcccatgtcaaggcatagttcggagtcgctccagccacaatcgtatttgccaagttattaccaaagatatatttttcacccaattgatacttttgcaaataagagaacgcatccaccttgtcaatcgggtccttgctcaaatccatatcattacccgtcgtaccataagaggcacggatcttcaaattactcaaccaatcagatgtcggctccatgaaagactcttggctgatacgccatgcggcagatacagaggggaagaagccccaacgcttaccgtctgggaaaagggtattaccatcgtaacggaaagaaaattctgctatatacttctgatcaaatgtataattgaaacggccgatccaagaaaggcgccctccgttcttctccttcgcctcgccccagcgtcgcaaagcatcggatgagtagttgaacatctggtctaaattcgtaagcggagactcacctttggccgatacctcctcgccaccattagatgcctgctcgaataccaccatggctgccacatcatgcttaccgaacgtattggcataattcacgaaccagttgaattgctcggtccacaattgtttagtcttatactccagattctcgtaattctgcgagaagttgaaggtattatattcattcaaattcaatggagccggcaaaaaacgattgccttgcggatccgcttgctggaatttatagtttttctggaaggtcataaagcgcttccggttgtaatcgtggcctagataagaggccatcactttcgtgctcaaacctttcgttatgaaatcaaggttgatattgaacgaaacgataccgttcaaattacgccgacgtgtcttcaaataacggtttccaaccacttgatccacgggattccatccctgccaagagccatagtcttgatagatcggataatccgtgatggtgttagcgggcgttccgtctaagtaagagtaaaacggcgttgtcttcattgcgttgaaggtacaacgatataaatcgtacaccgattggtcgtcatcgtcagagaaaggccagtagaaacgcttatcgttcgattgattcgcatccaagttcacattcatggttatatacttggtcaaatcgacagaaaggttcgaacgtaaggagaatttcttattctccaacgacacatacgatccctcctcggccaagaacgatcccatcacataatactttaccttatccgtaccaccgttcacgctcaaggagtgtttcgtattccagggattctgccaaatataatcgttcacgttatagttgatcttattatcacggaaataggcatactcctcctcgccattaggaagcggcgtaccttggaaacgagctaccgcattctggtagtccaaatcatcaatcgcatcccaacggtcggcaaacaattcctgagtcggtttactaaacgcataagaaccttggtaattaaatatcggtttttggtttttcgttcctcccttagtcgttaccaacacgacaccatttccagcagcggaaccatagattgaggcggtagccgcatctttcaagaagctcatttggtctatttcataaggttccaataagtcgaaagcctctttatcgcgaatcaccccatcaataacgaacaaaggatcaccgaatcctccacgcatacgaatctcggatttagcccccatcaaaccagagttgcccgtgatcgtagctcccggagcacgtccggccaaagagtttgaaaggtttgtactcgggatcacagatagatcatccgctttcacgttcgatatagacccggtcatgttcacttttttctgcacgccataacctacgacaacgacctcatccaacttctgcgtatcctctttcaaacggatttccaacgtacttttccctgccacaggaatctcacggtctagatatccgatataagaaaccaccaagattgcgttttcaggaacattgattaacgtaaacttaccatccatatcggtaatcgtaccgtttgtcgtaccttttacaagaatgtttgcaccaatcactggtataccggcttcatcaataacggtacccgtcaatcttatatcattctgatttacagaataattatgggggggggtattttgtacaccatacaacggagagaacgctcctaacgctaaaagcaccgttgctaagtaatatttattattcataaaactagatttaagtctcttttacacttgaattatactaaaaattcttttcaaaaacatctcatctgaatgagattacccacacactgttctatccatctctcaccatatctaaaatttaagatttattcattaaacatcaaggttaacttgcctcaaaatcttgtttgcattgagaagcatttttcttttcaccgcaaatataaataaaaatcataaaaaacaaacaacacgatcaggttccgccaacatccattcaataattcaatccgaactacaaatagactatagattgaaccaataattcattttgatcatgaacgtatttgtagcggggagtccccacatacgatccagattacttccccagccggaggagtaccagttgtcccggttagacatccggtgttcccatacgaaataaagcgtggaaccgggcaagtattcccagcgggctaccaagttggaacgaaactcgttaaacctaaaatcagggttcctaaaaggcatctgcccagctccctccccgatggtatagactccatccgcataagtcaattgatccggatcaatacgttggaaacggttctcaaaggtatgcgacttcgtatccgccgctaatttaaaatcatcgtatttagcgatggaggtgaacggggcaccataaaattgaatggaaatatcgggggtcacgttcacttgtaatttcagcgtgaggccataggtcttctgatccatgtggcccatgacataataataaggggccaagctactcgagctaagcggactcgtcgtagccacatattgcatctcatccgtattccacgcataatccagttgaccggacaaatagacatggtttcccaagcggaatgtcaagctcggcgagatcgtattgaagcgatttccctcgaaattatgatcgccctcgtatttgagcatgaacatcattcgtttcgccttatcggtattgaacttagcggaagttaagaaataagaaccgaagcgaacatccggtccccctcgcagcaagcggctatccagccaattccaagcaaaggtttccttgacatcccattcataccggttcatcgtcatactttgccaacgcaaagaagcgttgttgctaaaaggagtaccgccgtaattccacatattcttttgggacagggtaaaggcgttgtaccggaatatcttccagatatcggtctgccgatacatgatctccgtctcattcatcagataatctgtctccttcatatatcccatatcattcaagtcgaaaccgggtgacgaccaagtaaaggtctccgagaagttccatttggcgtttcctttccgtcccactttcacataaccacccgttccggtcagggagcgacgggtaggatccacccccagataatcggcggaggaagccctttgataataatgcgccacgctattctgcaaagccgtgatcgccccggcgctaccatgcaaggaactcaacattccctttacatctatataataaaggcgattcttgaaatactgggtaaagtcaatacccgccgtgaaagcgttacgcaccatgaaatcctccagataaggctgatccaaggcacggtttaccgaagtcaccataccgcccagcaaggtattccccttccagttcttttgcacacgggccacggtatagtttgtcaaaggctccacgacttccacatcctccaccccgttacgggtaaccttggaggaggaacgtgccgttacgctctcgatcactccgatcgtcaagccccgtttattcgtacccgtcagtttcaaagcaccaataatcggcacattctctttcgtctcggcataactgcctacattgtctataccccgtggcgtataagagggagaggcgccgatcctacgggtataaaacatcatatcgctaccgttcgcaaaatccaagatatgttttccttccaagaagaaggggcgtttctcatcgtaaaacgtctcgtaagccgtaaggttcattacggaggggtccaactccacttgtccgtaatccggattgatcgtcatatccaacgtataatccgagagggcgaacttagcgtccaagcccacgtttcctccccagctatgccctttttgataagggctgccgtctatccggggttcctgcctgtatttacccattacatacggcaagaactcgatgccgcgaggcttgggaacagagtccatgccgctcatgtttccgaacgaaaagacatgtccattattcttcaagggaatcatgctccaattttgcacctcgttattcctacgtatgatacggcgtacgtgcaagccccaaacgccatcctccgattgctggttatagcgcaactggctgaacgggatacgcagctcggcggtccaactggaatccgcccgatcaatatgcgtccggccctcccaaacggcgttccagctcttattgacatccaacttgtcggtaacgattaaatcggtcttattccctcccagattgatattaaattccggcgccgcccgataatcatggtaggtatcgaaagcgacactgatcaaatcgcccagactattatcatcccggttcccgataaaacggttcatcttatccggcacggcgtccttacaatacacgcctatatagatatatttatcatcatagaaaagtttcacccgggtcggagattgggtgatcgcccgctcataggggataatctgtacgaaacgatccgaccattcgccttgcttcgtccaaaagtcctcatccagcttaccgtcaatcgtaggtttcacttccgatactttccggatattataggtacgcttataagctttctcaaaagggacgatcgaatcttgctgggcttcgcacaacaacgagattcctaaaaacacgagtagagtcagatatttcataatggtctagactataagataacaataagcctcaaagataagcacttcttttcagaaaagaacacatcttccttagatttatcgcaacgaagccgaaggcatacgatatcaagtactcactgcaccccgttttgcagtattactgcgacacacgtgcagcgctactgcaaccggcgtgcagtaacactgcaatgcgggttgcagtacaataacaatagcgtcacgataaaaatcaacaaccgcctcccaacgcccggtatagcaatatcttcttccggcataaatcggtgacgatatcgatatgctccagctcgctatccagataacgctcctcggcggaaagaacctccaagaaaccggtatagcttaattggaacatctcgccggcattcaccacggaacgttggtgggcaagggattctttctctttcaagcggatacgctccgtttgggtctggctggcgcaatagagatcgagcacctcggtgtaagcgttcaaagcggtctcgtggtattgggataaagcgatacgctgggaagccttcgcctcgttccacatcgaacggatctcattgcggcggaagataggcgccgtgatacccgccgccaagtcgtacaccaaagaggccggcgaatgaaaccacttacccacatcaaacgcattgaaaccgccactggcgccaagcaccaacgagggatagaaagctgccttcgccgctatcacatccgccttggaggcgatcagctccatctcggcggaacgtacatccggacgcaacgtcaagaggttcgccggaatcccttccgacaagggaaccggcaacttacgcaactcatcgaatcccatccggcgaatctcgaaagggaaaacacccaacaggcaggcgatcgctcgctccttctcaccgatcaactgatcgttttccagcaacttactctcgatcgacagcacacgggcataaaactgatcgaccgccaactgcgtctccgccccttccttcttcaactggcgggtcagctcatgggaacgacgggcactggccagcgcgttccgcaacacctccttacgccggtccaagccgatcaactcataatattgaatcgccaaatcggagatcaacatcgactgggcaaaacgggtagcctccacggaagccatccagcgagcggcggcggcctgcttcttccgggtcagtttgccccagatatccgcttcccattgaaagctcaagctcaagccgaaatcccggtaagggtccggtatatgcttatcttttggcaaagaaggcacgttcgtctcgctattccccacaccatccatcgtatattcaccgaaacggttcacggaggctccgatgttcaaattcacgtccggcagcaaaagccctttcgcccgctgcaaggccgcgcggctcatggcgatgcgctccatgctctgccggaaggaatggttattgcgtaaagccacatccacatagcctcgcaataaggtatcttggaaaaagacatcccacgacagcggtttcacgaacgtagtgtcgttcattcccatctcgccggattccggaagcgagatccgctcgtccatcgatagctcgggagtcttacaaccggccaaagcaatcagagccaaggcgcagcctatcattatatatctcatcttatcaatacacatactcgtcttctttaatttgctctttctcttttctctttttaaaataagtagccagcgactcgaagatcacgtaaagccccgggatcaagaagataccgacaaacgtaccgatcaacatacctccggccgccgccgtaccgatcgaacgattacccaaggcaccggctcccgaggcgatcgtcaacgggatcaagccgctgataaaagcgaaggaggtcattaggatcgggcgcaaacgactggtagccccttgaatagcggcccccatcacgctgataccttccttacggcactggttcgccacctcgataatcaagatcgcgttctttcccagcaaaccgatcaacatcaccaacgccacctgcgcgtagatgttattctccagccctaccacgtacagcaagaagaacgagccgaacacacccgccggaagcgacaggatgaccggaagcggaagcaataagctctcgtattgggcggcaagcaacagatagacgaatgccaaacaaatagcgaaaatcaccaatgtttgcccaccggactcattctcctccttcgccacaccggaccattcggtatcgtaaccacggggcaatacctcggaagcgatctcctcgacagcagccaaagcctcacccgagctgacacccggggcggcctcgccggtaatcatggccgaggtaaacaggttgtaacgggtaatctggctcgggccatacacacgctccatcgtcatgaagttggagtaaggcaccatattcccctccttattcttagcatacaggctgaacaaatcctccggattcatacgatactccggcgccgcttgcaacatgaccttgtacatctggccgaaacggacgaagttggaggaatagaaactacctacataggattgcaaggtttccatggactcgttcacgttgatgcctagcttagccgccttcgccaaatccacccggagcagatattgcgggaaattcgggttgaagccggaagtgacaccggtcaggcgaggatcagcgttcagcttcgccacgaagttcttggcgacctcatccagctcggcgaacgtaccggcggtcttatcttgcagacgaagctcgaagccactcgcgttaccgaatcccggaaccgtaggcggtaggaagaactggatgtccgcatccttgatatgggcgacacgatcggcgtacacgctcatcaactccgccgctgtctgctcccgttgatcccaaggggtcaggttaatcatacccataccgaagctggcaccctccgtctcggtcatcaagctatagccggccaaggtagagatcgtctccacctcttccaacggcaacaaagccgcttgcaccttgttcaaggccgcttccgaacgctccaaggtagctccgggaggcgcatctacgttcacatagatcataccttggtcctcgttcgggataaagccggaaggcaacacgaacgtcatgccccacgtggccagacagaaaaggatcaaggttgcgtacgtcagcatccgacggttcaagaaccatcttaaattcaagcgataacgacgctccaagaaatcataacggcggttaaagccctcgaagaaacgagtcagaaggcccttcttcgcctttttcgaatgagataccggcttcagtaacaaggcgcaaagagccggagacaacgtcaaggcgttcacgccggagatcacgatcgccacagcaagcgtcaatgagaactggcgatagaagatacccaccgtaccatccatgaaaccgaccgggataaacacggcggacatcaccagcgtaatagcgataatcgcccctccgatctcaccgatcgcctttttcgtcgccttcaacgggggcagcttctcgttgtgcatcttcacgtggaccgcctctaccaccacgatcgcgttatccaccacgataccgatagcaagcaccaaggcgaacaaagtcagcatattgatcgagaaacccagcatctgcataaagaagaacgtaccgatcaacgataccggaacggcgatagcgggtatcaacgtagaccggaaatcctgcaagaaaagatacaccacgataaataccaagataaacgcctccagcaaggtcttgagcacgaccgatatggaagcgtccaagaaacgggatacgtcgtacgagatattatattccatacccggggcaaacgtcgtttccttcaattcctccatcttcgccttgatctgctggatcacctcacgggcgttcgagcccggacgctgcttgatcatgatagaggccgagggctttccgtccgtcatggagatcatattataatcctcggaatcaaactcgatcgtagccacgtctttcaggcgaagcacggaaccgtccggcagggctttcaagacgatctcgccatattcctccggcgtgctgaacttaccgctatactgcaagacgtattgcaattgctgcgggatcttgtcggagctgatacccgtcttacccggcgccgcctcgatattctgcgagcggatcgcctccgtaacctcttgcggcgacatattataagccgccaaccggttcgggttcagccatacacgcatcgcatagtcgcggctacccatgatctccacgaatcccacgccatcgatgcgcttcaactcacgcaagatattgatatcggcaaagttatatacgaatttctccgtatgggtactatccgagctcatgatgttcaggtacatcaacatactgtttacctccttctccgtaatcacgccggcacggatcacctcttccggaagctcatccagcacggtggtcacacggttctgcacattcacggaagctacgtccgggtcggtaccgaccttgaaatagatcgtagtcaaggacataccgtcgttcgtacaaacagaggtcatataggtcattccgggcacgccgttgatagcacgctccagcggggtcgccaccgttttcgccatcacgtcggcgttcgctccggtataacgggcggtaacggtaacggatgggggcacgatatccgggaattgggtgatcggcaaggagttgatcgccagcaatcccaagaagacaattaccaccgatatcacgcccgataagatagggcgtctgataaatatttcaaacatagggcttacttattattctcgatttcattagacgattccaattggcgacggatcgtggctccatctaccatatcgggattgatagtcatgccgtctgtgatcatctgaacaccctcgtagacgatgacggtctggtccggcaaatcctgtgttacgtaataagaaccgtggcgggccaacggctcgaagctacgcacgctcacctttccatcttccgctaccgtatatacataggtaaaatcctgtatctcgaaagtggattgctggggaaccaagaccacgttctccatcttggtcagcatccggatcttaccggatacgccatgtcgcagcaaacgttccgggttcgcaaaacgggcacggaaagcgatcgatccggtaccccgctcaaagtcgccctccacggtctctaccttccctttataccgataggtggattggtcggaaaggatcagctccagattattatactccggctggtcgataccgctcaactgcgtccgtttatattccagatactccttctcgttgatcttgaaataggcgaacatatccgatacgtccgtcaaggaggtcaataagctgctcggcgtaaccaaacttcccaccttaaaggggatgcggtccacgtatccctcgaaaggagccgtgatcgtcgtgtacgagaaattagtctccgcacgttgcaaacgggatttggcctgttgcacctgcaagcgtgccacgtccgcctcggccatcgcctgctccagacgaatcggcgagatgatatctttctccaccaaacgcttgatgcggtctacctctacctccgccatcttcaactcggcttgggcctgtttgtgattggcttgcgcctctttcacctcctcgtacaattccgccgaggaaagcttgaaaagcacctgccctttcttcacgtgctcgccctcatctacaaggacggcctccacgaacccttccactttcggtttcacctctacgaactgtacggcttgtacatccgctacataggactgcggcacctcgatcgtggtcgtggttaaccgcatcaccggcgtatgatctttcttcccggactttttctcccggttttggctacaagatacccatacacaagccgttaagcatagtaagggtaaatagttagaaaacaattttatcctcataaaacttatagatttataattatttgaatacgacgaaaagcacataggcgaatcaccccatgcgcgacaataagaaacaggtaagttctactaaatcagataggaacagaaccaaacgaaattctgtgctttgtgtaggttataaaataaaggaagcttggcgcattgccgtagttccaaggaatgaattaattcatgtaaatccagaatcgtaaacaagtcccatatcaaatcgatctccaaggctcggatttgcacttgctcctgacgtaccgttcgcaaggaggcgttatcgtcaaaatccaacaacacatcgggtgcctctttatcgactatttccatcgaggtagtggtaatattctccggaaagaaatcgcttccaatggaataaaactgtaacagcaccaacatgatcataagcatgatacgctggtgaaacccaaaacgattattcactgttacatttagcatcttttatctaatggaggcgcaaagataaacaatctttttgggaagaaaaaacatttcacccgcatacgagtattggtatcgccccacgccggtataggcatgaggcgatgccggtataggcgtagggctacaccaataccgacacaggctcacgcctataccagcacttaaatatatgcttttaccttctcccgatccgtttgcaccgtctcgaattcggaggacacgatactgcttcccatcgggacattctcattgcggtattccattttactatatacgatacttcgggcggacgtatgaaactctttcgctcctgtctccgcctctattttcccgatattattctcacgtacgccacatcccggcatgatgatgatccgtccgtccgcacgtttcaccagctcggcgatcaaggggattcctttcacggcatccgattgctggccggaggtcaagatacggtcgcatcccaactcgattagctgctccaacgcagtgaatgggtcccggcaaacatcgaaagcacgatgacaagttacggacagaggttttgccgcctcgatcaagcgccgcatcaagggtacatcgatatccccgtctttcgtaagacagccgaaaacgacgccatgcacttttagctccttgcacagttctatatccaatagcatggattgtacctcggcttccgtatacaagaaatcaccgcctctcggacggataatcacattgatatcgatcttggaagtcagagccttcgccgtcttgatctctccataactaggtgtagttcccccttcgggtatcccggcgcaaagctctacacgggtagcgcctcccgcctccgcctccacacagctctgggcggagttcgcgcatatctcaataattcgtttcatgtttatttagtattgttgacgtacaaaattacataaatatcaccacttgctcaacagaaccacaaataactatccgataccattaaaaacacctctattatggattaacaaaataaaacagaactgtcacctttactatcaaaaaggcagcaaattcgtatctccttatctatctatgccttagaaatttgactatagctttctgattcgtccaaataagaaacaaattggtctatttcggaactacagctaaatagtttaatgtttaactaatctcaaaaagacacaaaaagttctattttcaaggatcgaaacgccataaaacgtaatattgcaacgacattttaataggttaagataaataacaaataggctttatgggagaaataaaaggctatatctcacaggttatcggcccggtagtggatatccactttgattatgggacagaagaaacagtaaccctcccccgtatccacgacgccatggagatttcccgcccaaacggaaagatcttgatcgtcgaagttcagcaacacatcggggaaaacaccgtccgtaccgtagcgatggatacgaccgacggattgagacgaggcatggaggccgtgtcatacggaatgcccatcaccatgccgaccggcgaccaagtcaaaggacgtttaatgaatgtcaccggcgaccctatcgatggcatggcccagcttactaaagacggggctcttcccatccatcgtgagcctcctaaattcgaggatctgacaacgacccaagaggtcttgtacacgggtattaaagtaatcgatttattggaaccttacgccaaaggaggcaagatcggacttttcggaggagccggagtcggcaaaacggtattgatcatggaattgatcaacaacatcgcaaagaaaaacaacggattctccgtcttcgccggtgtgggtgaacgtacacgtgaaggaaatgacctattgcgtgaaatgatccaatccggtgtcatccgatacggcgaggagtttaagaagagtatggaggcaggcaactgggacttgtcgaagatcgattacgatgaattggctaagtcgcaggcgaccttggtattcgggcagatgaacgaaccgccgggcgcccgctcgtccgtggccttatccggtttgacgatcgccgaatccttccgtgacaaagcctctgagggagaaagaaaagatatattattcttcatcgataatatcttccgtttcacccaagccggttccgaggtttccgccttgctggggcgtatgccttccgccgtaggttaccaaccgacattggccacggaaatgggagctatgcaagagcgtatcacttcaaccaagaagggctccatcacctccgtacaggcggtgtatgttcctgccgatgacttgacagacccagctccggcgactacctttacgcacttggacgcaacaaccgtcctcagccgcaagatcacggaactcggtatctatccggccgtagacccgctggaatccacctcccgcatccttgatccgctgatcgtaggcaaggagcattacgacacagcgcaacgggtaaaacaaatcctgcaacggaacaaggaacttcaagatatcatatccatcctcggtatggaagaactttccgacgaggacaggctaacggtcaaccgggcccgccgtgtacaacgttttctgtcccagcccttctccgtggcagaacaattcactggcgtacccggtgtcatggtctctatagaggatacgatccggggattcaagatgatcatggacggggaaacggatgacatacccgaacaggcattcttaaacgtaggaaccatcgaggatgtcttggagaaggccaagcagctgaaagaacaagcaaattaatcgatatgaaactggaaattgtatcaccggacggcattcttttcgaaggcgagaccgaatctgtctcattcccgggagttgccggttcattcgatatcttgcctcatcacgccccattgatagcagcgttgaaggcgggtacgatccggttcgaggcaaacggcaaaagacaagaacaaacgatacaaagcggattcgtagaggtaaaagacgacatcctatccgtttgcgtcgaataaaaacatacgacaatgaatggcagattaaaaatgaggttaatgggtttgatcacgtttatcaacgtggcaataggcgtttcattgggtggtttattatataccatctggccggaacactatttctcgtggtatccgtccattcccttcttttactgggtcatggccatggcgatgactttcttcctagaccgggtaaaaaggaaaaacggagatgtgaccgtaaccatgtacatgctagtccggttgtgtaagttcacgctcgctttcgtcttcttatggatgtacgcagcgtttgtcgggcaacaattaaagacatttggtttcacgttgatgttattctatttcatttacctcggactggagacttacattttatatctgtttgaaaagaaaagaatgaaaagagagaaaagggaaaaggatgatgagtacaatcaaagataacaaatacatatggatcgctttctggatgtggctcagctttctcactccggcaaaagcggcgtccggcgagatagacgtgcaggatatcgtcttctcccacattcaagacgcctatacatggcatatcacggaatggaacggacaagagattgcgattcccctgcctatcttggtaaaaagcgaggaaagaggatgggatttattcctgtcatcccatctacatcatggccggacgcatcacaattattatatcgccggggaaggtgagcatgcgggaaaggttgttgagaagaacagtgcaggagaagaggttcgcccgatggatttctcattgaccaagaatgtttgcggactgttcctcagttgcggcctcttgcttttcatcgttctccggaccgcccattggtataaaaagcacccgaacgaggcgccgggcggatttatcggattgatggaaatggccatctcctacatacaagacggggtgatcaaagaggcgatcggaaaagaatataagccgttctcgtcctatttgctgacggtatttttctttatcttgatcaataacctgatcgggatcataccggttttcccgggaggcgctaatattacgggaaatatagcggtaacaggcgtattggcactttgtacgtttatagcggtcaacctgttcgccacgaaagtgtattggaaagagattttttggcccaaagcgccgatctacttgaaactgcccttgccgatcatgccgttcgtggagttcttcggggtattcaccaagccgttcgcgttgatgatccgtctgttcgccaacatcatggcgggccatacgattatcttggcgctaacctgtttgatattcataacggtaacgatgggagtagccgtgaatttcggtatgacgatcgtatccgtcttgttctgtgcgttcatgaactgtctggaattgttagtggcttgcttgcaagcttatattttcaccctgctgtcggccaactatatcggattggccaaggtaagggaataaatccaaagaaattaaggtattagaattatattattaaggttactaatttaaaattaaacactatgttatcgactattttattacaagcggcagccgggatgggcgtagcgaagatgggagccactataggagcgggattcgccgccataggtgcaggtatcggaatcggattgatcggtaaaggtgccgttgaagctattggacgccagccgtcggccgcaggagagatccgtacctcgatgttgattatgggagcgttggtagaaggtgtggcattgttcgctattgtcgtatgtttcttagcgttgttccaataaaaaagtaacaaactatgtctttattaacaccggattcagggcttctattctggatgatcgtttcattcgggattgtcttcgtgatcctttccaaatacggttttcccgtgatcgtcaaggcaatcgaacaacggaaagcttacattgacaattccttagagacggcacgtcaggcgaatgagcgacttgcccatatccaagccgagggcgagaagatgctagccgaggccaaggaaaagcaaaacgccgtcctgaaggaagcctttgccgaaaaggagcggatcatcgaggaggcacggaaaaaggctgtctccgaggcacatctgcagatagaggaggctacccggcgtatccgcgaagaaaaagagaaagctattcgcgaagtccgctcggagatagcggatctgtctatcgctatcgcagagaaagtaatgaaagagaaaatcggccgggataaggaacaacaacagatgatcgaccggctgctggatgaggtatcgtttagtaaatcgtaaggtatggatataggaactatttcttcccggtatgccaaagcgcttttctccctagcgaaagacaaggaacaggaaagccgggtatatgatgatatgaagatgttggcggacagcttctcgatggagccggagcttaggggcgccttgagcaacccgatcgtttccgtaccggagaaagtgaaattgcttacggcggcggggggtatcgaggtctgcgagctatatacacgttttatcaatctggtattagcccataaacgggagacactactgcccttcatcgcatacatttatatccatttgtaccggaaagaaaaaaagattacccgggtacgattcgacacagccgtaacggtagacgatgcggtcaagtctcacctgcaagacaagctacggaaagagacgggatgcacgatcgagttctccggccacgtggaaccggaactaatcgggggcttccgcctacgcatcggcaattaccggatagacgctagctatgcgacgcaactacgggatatccgtaccgggctactcgaaaacagataaaaaagaagaagtatgacagaacagataaaagtgagtgaagtctcctccatcctacgccagcaattggaaggaatccataccagcatcaagctggaggaggtcgggaccgtattgcaggtgagtgacggcgtggcccgcatctacgggttggataacgcggaggcgaacgagttgcttcaattcgataacgggatggaagcgatcgtgatgaacctagaggaagataacgttggcgccgtccttttaggtccgaccgaccgaatcaaggagggcgacaccgtaaaacgcacaggccgtatcgcctctatcgatgtcagcgaggggatgatcgggcgtgtgatcgatccgttgggaaacccgatcgacgggaaaggcgagatccttggcgagacttgcgagatgccgcttgagcgcaaggctccgggcgtgatcttccgtcagccggtaaacgagcctttgcaaaccggaatcaaggccgtagacgctatgatccccatcggaaggggacaacgtgagttgatcatcggcgaccggcagacgggaaagacctcgatcgctatcgataccatcatcaaccaacgtagcaactacgaggcagggaacccggtttactgtatttacgtggcgatcgggcaaaagggttccacggtagcggccttggtgaacaccttgcaagagaaaggcgccatggactatacgattgtcgtaagcgcaaccgcctccgacccggcggccatgcaatatttcgccccgttcgccggagcggccatcggagagtacttccgggatagcggacgacacgccttggtggtctacgacgatctgtccaagcaagcggtcgcctaccgtgaggtttccttaatccttcgccgtccttccgggcgtgaggcgtacccgggtgatatcttttacctgcactcccgcctattggaacgtgccgccaagatcattaaccagccggaggtagcccgtgagatgaacgatctccccgagagcatgagagacaaggtgaaaggcggtggctccttgaccgctttaccgatcatcgagactcaggcgggagacgtatcggcttatatcccgaccaacgtgatctctatcaccgacggacagatatttcttgagaccgatttattcaaccaagggaaccgcccggctatcaacgtcggaatctctgtttcccgtgtaggcggtaacgcacaattaaaggcgatgaaaaaggtagcgggtaccttgaaaatcgatcaggctcagttccgtgaattggaatcattctccaagttcggaggcgagatggatgccgtcaccgctttcacgatcgataaagggcagaagaatacccagttactgatacagcctcaatatagcccgatgccggtggaagagcaaatctcgatcctttattgcggaacgcaaggtctgctgaaagaggttccattggacaaggtgcatgagttcgaggcaaggttcttgcaagaattacggacctctcatcaacgggacgtactggatgtcttaaagaccggcgttatcaatgatgagatacgaggcatattggaaaaaacagcgaaggagctatgggttcattgaaagaaataaaagtccggatcgcctctatacggagtacgcagaagatcaccgccgccatgaaaatggtatcgtcggccaagtttcatcatgcccagacgcaaaccgagcacacacttacatatgctaataaactatccgctatcttaaacggtcttctttcggcggaatgcgacctagactcaccttacaccgaacagcgtaaggtgagcaaggtggctatcgccgtattcgcctcgagcacggggttatgcgggacattcaatgccaatatatggaaagagttatccgccacgatccagacttataagaaccagcaaatagaggtacgcctctaccctatcggcaagaaaatagcggatgagcttcataaagcgggttatagcttcgacactgatttcatcacgatcggcgaaaaaccgtcttatgaaagcgccgtatccttggcgaaccgtctcatggagctgttcgtcacaggtaaagcagaccgggtggaattactgtatcaccatttcaagaacatggcgacacaagtcgtaacccacaagacgtatcttcccctttccctctcggatacggaagcggcggaaacggccaccgactacatccttgagccctcggcggaagagttgcgtaaccggcttttcccgaaattgctgaacctaaccatctatacgatcctactcgacacctcaaccgccgagcacgccgcccgtatgatggccatgcagaccgccaacgacaacgcaaacgatttaatccaacaattaactttgcaatataataaaacccgccagcaggccatcaccaacgaattgctggatatcatgggaggagcggccgtttcatcgtaataaaaacgggatgcttccttggctaaacagacaatgatccgtatgtaaaacactttactaacggatcatttcttatttacaaaaaaaagtaagacctttgctcaccaaaacataagcctgtatacatttatattataccaatctaggatcgtacttatgatgaatcaagaaaagctaaaagggcatctccttattttagcggccaacatcctgttcgccattaatatgcccgtatccaaatatctactccccgagcatgtgcaacccgaggcgctgaccagtatgcggatgagcttcgcttgcgtgatgttctggatcacctccctattcgttccctatgagaaagtgccgttgaaggacttgggacttctatgcctttgcgccctttgcggagtaggcttgaaccaagggctgtttatctggggattgaataccacgtcgccggtagacgcttccatcatagcgaccgccgtccccatctttgtcatgatcttggcggccctgatcctaaaggaaccgatcacacggatgaaaacgttcggggtactgcttggcatatgcggggcgatctccttgatactacaatccacgcaaggttccaatcaagcgagcagtctagggggaaacctgttgattacggttagcggattcatgtactcgatctatttggtagtatccaagccactaacactcaagtactcatccgtcacgatgatgaaatggatgttcctgttctccacgctgattaccctgcctttcgctatcgaatccatctggaataccccggctttccacaaagaggtcttcgacggccaagagttgggagccatcttcttcgtgttattcggggccacgttcgtaccctatttattaataccgctggccttgaagcgaatccgcccgactaccgtcagcatgtacaattatatccaaccgatcgtagcttcctttatcgccgtattcatcggtcaggatagttttagcgtaacgaaactagtatcggccgcacttgttttctccggcgtctatttagtgacccaaagcaagagccgggcggaccttgaacaacaaaatagtcaatcttttagcaaaaacgcttgcaatatgaaaaataatgcgtaatattgcccccataatataaaagaataagtagcatacaaaatcaatgatgagtgtagagtcctcatattatacatgggcattgatgaccccttgggggttagaatctattaataagcattcgcgtagaccacgtcacgctatgtcgcaatctcgtattgcatccttttttatttcttcttttacataaataagtttaatcaatcggtcatcgtgggtcgctaatcatgaaaaagccttttcttgattgtcaatcctcgatgaaccattaaaaatacatatcgatgaaagtattaaaattcggcggaacatccgtaggttccgtgaatagtatcttaagtgtaaagaaaatagtagaggctatcgaagagcccgtaatcgtggttgtctccgctttagggggcatcaccgataaattgctggccacttctaccatggcttctaaaggcgaccttgcctacgagaaagaattatcggagatcatcgcccgccatctggacgtgatcgagggagtgatcgaggacaaggaggtacgcatggatgtccagaagaaagtgatggctttactggatgaattgagcaatattttcaaaggtgtttatttgattaacgatttatccgccaagacatccgatacgatcgtaagctatggcgagcgcctatcttccctgatcgtctcgaacgtgatcaaggacgctaagttgttcgactcacgcaaatatatcaagacagtcaagcaattcaacaagcatatcgtggatttcgacttgaccaacaagctcataaaagagaccttctcgccgctgcccaaggtttccttggtgcccggattcatctcttccagcacggaaaccggagaggttacgaacctcggacgagggggatcggattataccgcctccatcttggcgaccgccttagacgctaacaccttggagatctggacagacgtggatggtttcatgactgccgatccccgtgtgatcagctccgcctacgtaatcgaccggcttactttcacggaggcgatggagttgtgtaacttcggggcgaaagtaatctatccgccgacgatctatccggtttatcataagaatatcccgatccgtatcttgaataccttcaacccgaccgctcccggaacctatatctcgaaagagcgggtgaaagaggaaggcaaggccatcatcaagggtatctcctccatcaacgatacctgtttgatcacggtacaaggtttaggtatggtgggcgtgatcggcgtgaactaccggatctttaagacgctcgccaagaatggcatcagcgtatttatggtatcgcaggccagctccgagaacaacacgactttcgccgtacgtaacgccgacgctgatttggccgtacaagtattgaacgacgagttcgccttggaacgtgcgcagggtgatatgaacgataccgtagcggagaaagatctggctaccgtcgctattgtaggcgagaacatgaaacgtaccccgggtatcgccgggaagctgttcggtacgctgggacgtgcgggcatcagcgtgatcgcttgcgcccaaggcgcttccgagacgaatatctctttcgttatcaagcataaataccttcgcaaggcgttgaactccattcatgactcttttttcctatccgaatataaggtattgaaccttttcatcgccggtgtaggaaccgtaggcggcaatttattggaacagatacgcatccagcaaccgaaactgatgcggcaaaacggtttgaagctgaatgtcgtaggtatctcaaactccaagaaagcccttttatgccgggaagggatcaacctcgacaattatctggaggagctgaaggagaacggggaagagagtaacccggagcatctgtgcgaggagatcgtaaagatgaatatcttcaactccgtattcgtggattgcacggcaagcccggacgtagcggctctttacgagacgttgatgaacaataacgtgtccgtcgtggcagctaacaaagaagcggcctcctcctcctacgataattataccaagctaaaggagaccgcccgccaccgggacatcaagttcttgttcgagacgaacgtaggcgccggcctcccgattatcaatacgatgaacgacttgatcaatagcggcgaccatatattgaaactggaggccgtactttccggtacgctgaattatatctttaatacgatcagcgccgatatccctttcagcgaggcgatccacatggcaaaggaagccggatacgccgagccggacccgcgtatcgaccttagcggcaaagacgtaatccgtaagctggtaatcttggcgcgtgaggccggttatccggtggagcaagccgacgtaaaacggaacctgttcatcccggaaaagtacttcgagggttcccttgaggacttctggaagaatatcaaggatacagatgccggtttcgaggagaaacgccagctactggaagcggaaggcaaacgcttccgtttcgtggcgaagatggagaacggcgcttgcgaggtaggcctacaagccgtagacagccaccatccgttctatgaactggagggcagcaacaatatcatcatgatctccaccgagagatatcatgaatatccaatgatcatcaagggatatggtgccggggccgacgtgacggccgcaggcgtattcgccgacatcatatccatcgcaaatattcgataggtatgaagcacattatcattttaggcgatggaatggccgacgagccgatagaggctctgggaggcaagactccgatgcaatacgccaagacgccttatatggataaattggcggaactgggagtaaccgggcagatgaaaaccgtagcggatggtttccatcccggtagcgaggtcgcgaacatggcggtattaggctatgacctgccctccgtatacgagggacggggtgtattggaagccgccagcataggcgtcgccctgcagcccggcgagatggcgatgcgttgtaacttaatctgcgtagaaggcgacatcttgaagaatcactcttccgaccatatctccacggaggaagcggacgagttgatccaatgcctgaacgagcgattaggttccgaccgtgttaagttctatacaggtgtctcctaccgccacctattggtaatcaaaggaggcgataagcgtctggattgcacgccaccacacgacgtacccctccatcctttccggcctttaatgataaaaccggaagttccggaagcacgagagaccgccgatttattaaacgaattaatcctcaagtcccaagagatcttaaaggatcacccggtgaacctcaaacgtatggcagcggggaaagatccggcgaacagtatctggccttggtctccgggctaccgtccggccatgcgaacgatgcgggagatgtacggcttcggaaaaggctccgtgatctccgccgtcgatctcatccggggaatcggcgtttacgccggcctcgaggtgcttcacgtagagggagctaccggattatacgacacgaactacgagggaaaagcgcacgccgcccttgaggccctcaagacaaacgacttcgtctacctgcatatcgaggcaagcgacgaggccgggcatgaaggagacgtagacttaaagatcaagacgatagagtatctggacgaccgtgccgtacgtatcatctacgaggaaacgcaaaaatgggacgagccggtagcgatcgctatccttccggaccaccccactccttgctccatacgtacgcatacgaataccccggttccattcctgatttacaagccgggcgagcaacccgactccgttaccacatttgatgagttctccgtatcaaacggcaaatatggcatactggaaaaagatcaatttataaaagaatttctaaacgattagagcatgaaatattacagcacaaacaaacaagcccctgtagccagcctagaagaggccgtcgtaaaaggtctggccggcgataagggattatatatgcccgagtatatcgactccttggacgaggaggtgatagccaacatgaagaaccagtccttccacgagatcgcctgcacggtagctcagatgttcttcggggaagacatagaaccggaggtattggacggtatcgtaaaagatacgctctccttcgagaccccggtggtacccgtaaaggataatatctatagcttggagttatttcacgggcctacattggcctttaaggatgtaggagggcgcttcatggctcgtctgctcggttatttcataaagaaagagggattgaagcaagtaaacgtattagtagcgacttccggcgatacgggaagcgccgtcgccaacggattcctaggtgtcccgggcattcacgtgtatgtgctttatcccaagggaaaggtcagcccgatccaagaatgccagttcacgacattaggacagaacatcacggcattggagatagacggcacgttcgacgattgccaagcgctggttaaatccgcctttatggacgaggaattaaaacgtcatatgaaactgacctcggcgaactccatcaacgtagcccgtttcttgccccaatcgttctactatttcaacgcttacgctcagctggacaagctgggaaaagcggacgagctggttgtttgcgtgccgagcggtaatttcggaaacatcaccgtcggattgttcgcctattggatggggcttcctattaaacgtttcgtagcggcaaacaaccgtaacgacgtattcttggaatacctgaatacaggaacttatacaccccgcccatcagtcgccaccctagcgaacgccatggatgtaggcgatccgagtaatttcgcccgtatcatcgacctattcagcgcattcaatgatccccataaagaaatatgcgcactgatctccggacatcgctatatggacgaggaaatcgcctctacgatgcgagccgtctataaagagacgggatatatcctcgacccgcacggagcctgtggctaccaaggattactagacagcgacctaagcgagaccgagacaggtctattcctcgagaccgcccatcccgccaaattcaaaggaacggtcgataagatattggaggcagatatcgagatcccggcgaaactgaaagccttcatggaaggaaccaagcaaagcatcgagctggcaaaagacttcgagggattcaaatctttcttgatgagccggtaaaaagaagaatagttttcgtaagtgataaggggaggtgtggcaaatatcgataatatcaatttgccacaccttccattttatatcacctaggacatacaaaacaggcgagaatttcaaaaagaaattccgtaggcaagctatcgcctattggcacaagtctaccaccaataaatagtgagctacctatattttcacgaacgagatagctcttttctttatttaactaaattataaccaagcttttcttccgaaaagtcatgttgttaaattcgattaattataagccaaatgtataattattggagaaatagagtttttataggatcagtcgataattgatggggataattattttcatctatttaaaatctctacctttgctctatggaaacgaatcaactttatacattagctcagatagtactaccaagtgcagttcttacgtattttaatatcgtcaacatagaaagcacatccaccgagattttcatccatcttgatgaaaagatgagtgacagtcttaatatacattaaccgtctctcccccgatggttatcgggaaatggcagaggaactatagatacaagtggcccatttgtctttttgacaacttgtaatctgaagtcccggagaatcgattattccgtacctaagtgcgtctcgcttccaaattcgagagaaaaaaacagcaattctctgtttgatagttgtttgctgaaaaacggcctttcgttccagccgaaataattcaccctagttcatgttttacggccgtaaggcggtaataatgcccaacgctaccgcatgcgagggccgatgcctatatatgtgtaggcttacgccactatatgtgtagcttgacgcgactatatgtgtgggttgacactgctatatgtgtgagttgatacagccatatgtgtaggttgatacgtatatattcgttaaaaagcgacgcttatcatgttaaaaagcggaggtggcagcttgttcgcactccccgtttacgcccgttggcttttatagccagagagccgtgtcgtgaaaaagaaggtatttcaatcaaaaagatacctttcacgccaaactcgaagcacaggatctcaatccaccgcccactctttcatctcatacatatccttatattcttcccaatctggatccatctcggtataaatagagatgggcagtaattcgaaaggagccaaggcctcattcaagcgttcgccgaatacacgcacggtacgtgtgtaaaacacccagaccttctctcctcctccggtatagacacccgtcaggatagccagcttgtctttcttttccatcgccttacgaagcgcttcctccacggcctccattttctcgccaaggtcatcgctaggaaggcctctcccatctccctcgtatttccaagtgatctcgatacgttccttgaacttaccggattcggtaaactcattcaactcgtcccgcccgtaaacggtaatcatttgccctgactcgttttccgagagagccgtaaaccatacatcgcttaatctcatatttatattttctatttatctataagtattccttactgactttaccgggtaaaaatacgacaaaaaaggctgcgtccggtgaagatacagcctttttatatttctcgacggaaatttattatctctttcctaatctatgatccataatggcgtaatggcattccccataattcttcaattgatccacgatctctttagccgtagattcttcctctacttgctcgcgtacgaaccagaacaagaaatcacgggaagcatgatccttatcagcctcggcgatatcaaccaatttgtcgatcaactctgatacatagcactcgtgtttgtaaacatgctcgaatacctccaacggatttccccagcctgtcggaaccacgttgatctggccgatcgtaatatcgccgccacgatccaaggcgtaatcgatcaacttatgagcatgctccaattcctcagccgcttgtttcttcatccaatgggcgaaaccgttcaaccctgctttctggaaatacacggacattgacaaatacaaattcgaagaccacatctccgcattaacttgggcattgaacgcctctgataaatttctacttaagatcataattttatcattgtttaaaaatgttgaagtattatccgttcacgaaatttcactatgcaaatataaataaaagtaggattccttatctcatttccgcccttagatattggctactttcgaaaatttttctaacttacgcccttatttgataaacatcatgcaatacaccgacaaatatcgatctcccttgggagaaataaccctagccagcgatggcgaccacctgacaggattatggttcgacgggcaaaaatattttgccgccactttatcggcggaacaccaagaaagagaactgccgatattcgagcaagccaaagagtggctggatagctatttcatgggtaagattcccagcttcacccctcctatccatctggaggatacgcctttccgacttgcggtatgggacttattgagcaaaataccttatggcgaagtcgtaacctacaaggagctcgccggcgaaatcgcccggcaaaaaggtatcccgagcatgtctacgcaagcgatcggaggagcggtaggccataacccgatcagtatcatcatcccctgccaccgtgtcgtaggcagcgatggcagcctaaccggatacgccggaggtatcgacaaaaaaaggagcctgcttacaatcgaacgggccccaaaagtatcgtaaagagactttaccttgcaaatccttgtggacaaacatagaatgtaactatcccattaacgttatctccttcacctcatggtcctcaatatcagcatataggaagtggccggcgaaagtgtcttccgtgtcttggaaaaaaagctccagttcgtaatggatggagccgttttctttctccttggtctctatatgaacagattgcaattctacttggagggcaaactcctctctggacaatgccggaagttcacaatcttcccgccatgcgtttgctgtcgggagcaattcgtcggccatgcgcaattgccatatcgcttccccttcctcttccagcctattcatatagccactaatagctttcagatgtttccggataagggattcgtgcggacaacggggctccaagtttttaccgcattgcttcctaattagtttaatggtctcattcaaacattcaatcttagtaccgatagaaaccgagggcatttcccaaagtcgctcgtataactccaatcgtttttcaaacgagtgaagggcagaccttgctccaatctttatatcaagataagcatcataggctttagactcttccttagtcatatctcgctcaacgccgtttagcttattctgaccctcatccatgcgagtaatgatgtcattggtaaatttcactaattgacgtacctgcttgggtgtttttattttgtttttcttcgcatttttctctacgctttgcgcaaagaattgaatggtggccattgtaattgaaatattcgtatccgcacgcatcaaatcatccggcagttggacattacgcacaaggtcatataattcaattttataaggaatgagctgactgattttttcttcaacgggcaaatccggattgctccatatcttggtacagtcttgaatgattgccttaatcctctcggcgttcatgtaatccaaatagcgttgctctaacgcctcgtccaccttaggcggcaggagttttttgagagcttttatcttctttttgagttcgtctacgtaggcttgctgttccgggggaagcagctcattcttacctttttccgatttctcttcaatgataggtaatttctcggtcggtgtctccaagggagcgatggagatgcataggtctacctccctcccccaaatcgtcgctttatactcttcgggtgtttgatagccatgaaaccatgtctggagtgtactaagccaaaactccgtatgcatttccaaggtcattttggaaagctgggcgatcttatctgtcagatgaaattcccaactattttcattcgtttgttccttttccataagtatgaataattattatactgaaatagacaacttgatcacctttgagccaataagttttccccgtaaacgtatatcctgcaattaagataaatatatgatgattatagcttcaaagcgtaacgaacgctgttccatgtaattcaccacgttttgcccaaatcaacaattcataccccatggggcaattgttgttatcatattacagagagtctttcatgaaacaactgcttgtttctctaggtgtttccgttttctgctatatagcttatttcatatttgggatttgcttcaatttactgataagaggataggaaagaaagttaatgaggcggctccatcgttatttcggtgtgccgcctttttccgggtcgcatttattattctagctcatttttcctctttttccacagctgatagctattgaaaatattttgccacaggacatagcttcccgggccaacagaagacaaggggttcaaataggtgtaagacatccagatcgctaacacggtatttttttgtcccaaggcttgtccggcgctaatacggtcattgtatttcttgccgatgcgctttccccaataaaactgtgcgatacaggttatcaagccgcctaaagcgatcaggatttctacataaatctccgcctcgctattaaccaaggatttcacggtctgcccggtcacgatagctagagcgacggcccagaggtaaaaggccatatcccgaagccccgcaaggaagcgatggataggtggtatgaatctacgcaagaacaaagcgaggaaaaacgggaataacagcaatgggaagacttttcccaagatcttcaagaatgcggcgaagaaagtaatctcggcatgcggttccactaatggaaagaccagcggcacgacaatcgctgccaatagattcgataataaggtataagtagtcagactagaggcgcttccccctaatttacccgtaatcacggcggccgccgtagcggttgggcaaatcaggcagaccatcgctccctcgaacacatcccggtattcctctctcattggcagccagagcaataaggcggcaagcaccaaactggaaaccgcttggataagcaatagccaaccatgccaagggctgggcatcaattcccggacagagatcttacagaaggttaagagcaactgcgcaaaaatcaaaaagggcgtcagatacgctattaaagtgtacatgaacggctttgcaggctccagaaaagtaacattggcgaaaacaaaataccctatcgcacccgctaacatggagatagggagtgtccatgtcttgaagaatttcaacataacgcctattcttttaattcgggatgcaaaataacatctttccaccgaaagaggcaagagaaacggggattaattagggataaagagagacggggcatgccccgtctctacattagatattcttacagcttacttttaatgtccttatcccgtaacgagggatagaaagacgcattgaactggcgcctttcttctcggtgacggttaagtcctcaaccagacggttatccaattccaccaagctcgctttcacgtctcgtccttggaaggttatcgttttaggggaggcatcgctttgggcattgaataggcggatgtaaaggtcattacctttatagaccatggagaccaactcgtaggcattattctctatccggaaaagggaaccggatgtcaaggtagcatcgccgcccaaggttgcgaccaaaggctcattgcgtcgttcgctttgtgtccaaatacggcttttctcccaagttccggcatgagggatcaaggcatacgagatctcggtcggacggtctatgatataatcccggccccacaagcctttaccagcgtattgtacgttcaaggccaatgggaaatccttaccatgcgcatagctggtcgtatgatccgtgaataatgacagaccgcaagagttatccttgctcgctacatccacccaattcaagatgatattatgcttgatactatcccaacgattgaaaaaggtattctccaaccggctctcgcaaacatcgaacggagcatccttataaatctgttggttggcgatctggataggcagatataccagaagtttgtaacggtcgtcatagaatgacttacgaggattatccgcacggaattcgatacccggctcaccaatgcgagggtttcctgtccaatccagtttaacattcatatcgatgcgaggctctccctgcgttaaccggatcgtttgggtaaatgaatactttccgatcttgcctttcacagctaccttcacgaataagggcccttgctccaacacgctcacctcagccggttgatccatactggaaaggaaaccaccctcatcgataaaatatccccgaagctcattgaacccacgttcattccggttatccacgaattccttgcctcgtacggctttcgctttcaagctttctattacacctcctttagagggggttagcaccaaggtgtataaatcattttccatgcgaaacgtaccgtctttctgtctctcagccttcaaggttccggactgtttatcctctgccttccggatcgcataagaggcataaccggccgaggggacttgcgcacggaacaggagttttgaaatgccgtcttccgtcaaccattgaaccggttgtttctttccttgcttatcaagaaccacccaatccgagtttctccatgagacggggacttccaccgccaccaattcattccggtcggtagccaaggtattatatacgtacaccgtggattcaccttccttttctttcaataaggacaaggcgttatcaattatctgacggctgttttgaatggtcaccccagtccaatccgtaaccgtctccgcccatgtctttttcccttgtagttgattgtaaggaacgatccagcaatcatgatgctgggacaatagaagcgtgcgccatccctcatcgatacgttcagtcggccattccatgcctttgtataagcgagcgtaagccgccattttctccgcacgcacgatagcgttctcggctacccgtacctctccggccaaacgctgcatgacctgcgttccccacatcaagccacctaggacatcctcttgcgagaaatgccaatcatcccgagtagtcccgacggaacagtcttggatgtaattccgccaagtcttataggcggtcggcgtataatagcccgtcgtatcctgtcccagccaagggcctttatcccaaccatggctccatgaggcatcttggatacacatgccgaccgggtgctggatgccggcatccaagcatttatggatgtagtcctccgtattgaaccacgagatggattgccagcaagagccgggttgtaaatcctcgcaggcgtaacgggggacggtggtaagtctcgtaccatccggccctacccaattcaccaactcacctccgtaggcgcttacgtagccaccccacatcgtattcgggttcttagtagaggcatacgagaagccgaatgacttcaatatataaggcaggcaactggtaaagcaaggctcctccgccgaataggtggtgaataccgcctcagggaaatgtttccggattagccgcattccatattcgaattggcggatagcgctctcgccggatgtcccgaagaaataactttgggcataggtcgggtttacgtactcgatccgcccactctccacggattgatccttaaataagcgcttgaaagcctcgtaaccttcagggtctcgttgccgtacgacttcccatgattcaggctcgatctcgatattgatattccagttgggattctgccttaatttctgggcgataaaggcggtttgtcccaccgggtaatgcccgtagataccgccatgatagccatcgatgaaataggcttgttgggcatccgcccaaccggccaacaagaattggcttaatacgaatatcgctagtttctttttcatataatatgtactattaattcacatttagaatacttccagtcggtgggagacggggcacgccccgtctctacaagtctgtaaatttcttgatctctatctgcaaggggattggtttattttgctcatagatctggttaaccagatcctgttgctcattcacgcaatcctcacgaatccccttgtgcatgtattgtagccaaagggcgccgttccattgcaagaagatgtcgtggggacggtatttgcgcaaggtgtccacggcagcctcgttgcaggcccaaagcatgcccgtcttccgcatcaagttatattccacccaataaaattcacgcatcttacgctctttcaaccagcgttcctcgttcatctggcggatcttcatcgcttgtttatactgcggggtattctgaagaagagccatattgatacctcgctccaactccctcgccgtaaaacgaccgataaactccccaccgatcgtcaacccgtaatatccatccgacaaaccgctcacggacaatccctcataattcatctcatccataaaagggataacactcaaggcatctgcctgcgtatgtttctcattatcataataagaggtatcgataggatacggaagcgatttcgcctcgtacgtaaaagtaaggttatccgaggaaacagacaaatccgagacacggcaattatccgagcgagtcacctttttccccgctccgtctatccggatatcggctaccggcttaccggccagaccttgcgccttcaagaagagataagccatgaccagatgcccgtccgtagagggatgtatacgatccttcccgcataaggtatacatggaatcctccgcttgctcccattggttgatcgctaccatcgggcggttaaaatccacgaatccccattgattctcccgggcccgggcattcaggaaatccacgatctccaagattggcgtattcttccccgggaaagcgaccttattgaaacgagaagtctcgtcataaggagagcttccgatcaagattttcctcacctccggatacttcttatagacctcctcgataagggcataatcccggcaagctttctctacccggttccgggcgatcgtatccgcccccggcttccgaaaatccatatagccgacatcgttcatgccaaaagatagcgtcaccaccgtaggctcatgttcgaaaaccttatccaaccgctggtaaatcatctcggctacatccccacctactccctcgttaaagatatcgatgcgttgatccgggaaacgggtcatataatacagccagatatatgaatgataatgcccaccgcaagtaatgctgtttcccacgaaggcgatccgatctcctttctgaaacggagctatcgactgagcatatactcctgcaagacctgataaaagcaaacagacaaacaaaacatatcttttcatctctatttctctcttctctaattttctgtgatgaataatatataccgtgttaaaaaatattactatcaatagtaatcgtatttatcatggataataatccggattactacggatagtaatatccttccacacacctctagtctagagaatcgcccgcttacttttagcgaacgacatcctcaccaagcagagggttcagttctttctcacgcaaaggtaccgggaaaaccaaatccgattctttaaacggatacgtatgattaaccgcctgatagccgaataaatcaaccatttgcttcgaaaccggatcaaacgcacggtgagtacgcaacatatcataccatcctgtaaactcataacagagttcccacgcacgttctttcaatacttgatcaaccgtgattgaagtcggtctcgcctcattgggcaacgcacggtgacgaacttggaaataagcatccacagctatagcgtcggaagtagatccaccatccaaggtagcttttgcctccgcacacattaatagaacgtccgcataacggtaaaccggaatattcgccccgctctttcctgtagattcggcattctcatcccaatatttgcataaataaggaacatccaaagtaatcgttgtctccggatcaccatatttgggtttagaagtatagaaaaactcctcattccgtttacgaatatcttggtcatcataactttcataaaactctttacgaggagccaaaccacccccataagccggagtaatggaaatcggttgttccggataaggcaaaaggccaaaatggaaaggagccccggcatcttgcgcctcacgctggatcataaaaatatgctcaccactattttcgttctctgacgcacgcaaatccttataatcagcgaacaagctaaaggctccactatcaataacctccttggctttctcgtaagccaattgataatactcatttcctttttgaagcggataacctgccattgtcaaataaaccttagctaaaagggtcttgatcgctcccatagagacatggcctgttttatcactccaatccagcccggactgctccgcctttttcaagtcttccacgatctggttataaatatcttccttaggagacctggggatcttcaccgtattcaagtctatcgtaggttccgtcttcaacgggatatccccgaataattgtaccccttggaaatagtaatatgcccgcaagaaataagcctctcccagatacttcgctttctggctctcgctaataatatccgtagcggaaacattttgaatcacgctattacaattttccaaaggaaagaaagtagccttccagaagttacgaataatgccgttactctcttccaaaccggaaagcaacaagaactggttctgctcattaccggccgcacgaggacgataactagtacctacaagatattccaagttaaaaaggtgaactgtagcaatctcgaggtcggaactcaacagatcatcaagcccgtcataagtgccatccacagccgcctttatctggttctctgtcgtataatattcagaaggactcaagaaggttttcgggtcttcctctaaaaaattcgtacaggatgtaaaagccattgtcgcagaaagcaagccacacatccatacatgcgctttatttttcatatcttagttttttacgaagtaaagattaaacaattagaaattaacacctaaagtaaatgaatacgtacgaggtttgggataggtataaaaatccactccttgctcaaatacagcatcataactcgtcacctccggatcactaccagaatagttcgtaatcaagaacgcattctccacattgaatcccaaggataaactcttgatgtgagcggcagaaagcatacgggaactaaagtcatatttcaagccgatattacgtaaacgcaagaacgaacccggctcacaactccaagaatctacgtcattctcatatccatctcccggaaggcgcaagctaggcaccatcgtgttttggttttccggcgtccaagcgttcaccggaatgtccgcataagcattggagaatgtcacacggttacccatcaactggcgagtgaagttaatcaacttattaccatacacccattgtaaatcaaacataaacgtgaagcctttccacgagaatgtatttgtcatattcatctcgaatttaggagcgccatttccgatatagtcttggtcttcaccatccttcattccattaccatttttgtcccaatacttgatatcgccgggtttcttattatatttagcggcttcttccgcctcatcggttccccatgtacctaggcgaacatagccgtaaagggcatttaaaggatgtccctcttcaatacgtcctccccatttaccaatgatattatcatttatatccagtaccatcgatcggttcatcgtataattccaagaggtagtccataagaaatcacggctttggatattgcgtgtattcaagctcatctcaagaccttgattacggatcttacccagatttgtcatagttttctcatatcccgagttagaaggcaattgtagctcatacaataaatcagtcgtaatcttatgataataatccgccataaactcgatacgcccattaaagaaactcaaatcgatacccgcatcaagttgtctggatttctcccagcgtaaatccggatttgccatacttttcaacgtaacgatcgtcgtcatatccttgccaaaaggaaggcgtttattctcataacgtgccatagacgcataatcaccgatttccgcgttacccaccgtaccgtagctcaaacggactttcatatcatcaatcaccttttttgcgttctcgaagaaattctcattggatacacgccaagcggccgagaatgaaggaaagaaaccatattggttattcaagccaaaacgagaagaaccatcctcacggaaagaagcgcccaataagtaacgattgtcaaaattatagttgatacgggcatagtaagaattcattttattatccgtatagtctgagccaaccttagaacgtacggtgccgactcccatattattgtactcaaaataatcatcgaagaaattctcggcccctagctcgcttttctctgtttttgagtaataccaactggctcccgctacgacattcaagttatgcttattccagcttttatcaaaagtcaagtagtcctcattcgtccacgacatcgtatttcgatgtgctttctccgctttacccttttgagtatctccatagccgaataaggtactcgggttataagatgaattgatataagaaccatcctagcggctgaagctagtcgttaactttaaccaagaggtaatcttaaacgtaccaatcacgttagccaacgtgtactgattcttatcgatattcttacgttcctttaaaatcctcacgggattctccgtatcttccgcacctggataatctcctttacgggaataggtaccatcctcatattgaaccggaaggaacggtaatgcttccaatgtataccgagagatcgcattctccgagtttcgggcattactagatccaacattcaacatggcctgtaaatggaaccattctttcaaatcccatccgacattgataaatgcgtttaactgacgtttataggtctccaacattataccttgattatctttgtaacttacattcgccacagcggtcagcttatcgcttcctccagagaaactaagtgaatgctgatgagaaaaagccgtacgagtcacggcatcctgccaatccgtatcatatttcggagtcccgtccggattgaacaggtcattcttatgcgtaaacatattgctcggatccagatggggagcgatacgtcccggttgagcctcataagcacgcttgaatacatccaaagcctcttccgcatttaagacatcgactttacgagctaacgttcctgctgacagaactgtattatacgagatattcgtcgtatttttcttaccttcctttgttgttatcaccacaacgccattcgcacctctcgcaccataaatagaagaggaagtagcgtctttcaagatatcgatagactggacaatattcggatcaatctggtccggatccacgccaaccacaccatcgaccacatatagcggtgtattagaagaattcaaagaaccgataccacggatttttatcgcaggactaccacccggtgcaccagaattcaaggcgatattaacaccagccacctttccggccaatccttggaatacgttcgtggcattcggacgctccaataacttctccgagtctacggaacccactgatgtcgacaagtttcgtttcaacatcgtaccatatccaacgacaacgacctcttcaagcgccttataatcctcggccaacttcacgttaaacagtgtacgattcccgacctcgatctcttgctccgcatagccgatataggaaaatgacaggatatcgttattagccgcatccaagctaaactttccatccagatccgtaaccgtaccgaccgtcgtacccttaatcacgacattggccccgataaccggtatgccatccggatccgtaacgataccggagatctttttcttttgttgctgtacggcgtctttcttcaagatcgtgatgtgcttacctgatatgcggtaggtcaagttcgtgtttttcaacaactcattcaacacgtcggtgacttggcgattcttcacctgtatatccacctgcttactattatcaatatcctcgctcttatagaaaaacatgaactcggtctgtttctcaatctccgagacgacatcatagaacgtcccgttctttacttctaccgtaacttgagctttttgcgcataggtatccgccgagacatgcaatatacccagtattaaaaaaagcaatgtgatcttcatgattgatttaatttttttaggcaatagctcatcgctattccagactttttccataagtttgtaattattttttattaatgacttaccttgctcgctactttttagaggacagcgataaaggtgattaaacgaataatgaacgtctaagaatcgggggtgagtggtgtcagtcccgattcttttttgtgatcaggtatttgtcataggcaattcgaatgtttaaggttatacatctattattttgttatttgctcctcgccgatatcaggatatcttttccgtctttcgtgaaagtgaattgtttctccgagttaataatatctagcacctcttgtataccttgatccaaggagaaggttcctgtgtagcggatgttccgcagactgtcatgcgccaagcggatatttaccccatagtaattctccatacgttttacgatagagactaaggtctcatccttgaaacgatatttcccacctacccaagcgttcgagatcgaggcatctgtctctgacaagaaaatagagccggtccggttatccgaccgggcttgctggttcggctttagcttcatactactcattttccgtccttgagcgtcaaaagattccaataggatactaccacttaataaggtggtgacgctaaaacgatcatcgttgaaagcctgtatattgaatgaggttccgagtaccgtgatttgttggttctttagttttacgatgaaaggtttcgaatgattcttcgcaacctcgaaataggcctcaccctccagatgaaccacacgctcatctccattaaaagaggtggggtatttaaaacgggtggaggcattgagtatgatcttactgccgtcggatagcaatagcgtgttcgcacgtccgcctttttccactacaatctcgttatattccgtatcgccagcatataaacgattgcttatccattgattcatacccacacctattcccatagcgattacgataatcgccgcatatctcaagaatgaaagccagaactgtttgccaaggaccttggatttcacagatacgccagagatcgcatccagctttccagccattcgctcccaactacgctccacggaataatggttcaagaacgccacttctttccgagtgtcaaaaagccccttaagctcaaagaagtgggatttattagcgtcactctcgtgaatccaagcatccaacacccgaagttcatcctcctgaatctcgttctgcaaatagcgtatgatcagttcttctatcgaattattagattccattttctgtttcatttataatatatacgaccggttccctctttttacttacgtattctaccgtattttcatctaaaaaataaaatcagtgccagaagcaccaacacattccgtatgatcttcaatcctttatagagttgcgcctctaccgtacgttgagagatatttagcattcctgcgatctccactgatttcttcccgtccacataagccaacgtaaaaacctctcggcatctgtccggtaacttggctatttcccggtaaacggagtccagacgctctttctccagctccgccgcatccaaccgattataataatctatctcctctatctttagtctacgagcaacctcatccgcataagtcttttctattgatttatgctttaggtaatcgaggcaagcattttgaacggaacggaataggtatgtcttcaagccttcttccacggaataaatctctttcttttgccagatcttgatgaatatatcatgcactaaatcttccgccgtatcgctatccacatatttcgaggcataaaagatcagtctgggggcattctccagatataataatttaaatttatctaactcatggttcttaataatatagtctttcatgctcaacgtggacatttcttgtattatattagacagttcaaggcttctcctttgtctatatacgatcatagaaacagatatacttacgcccacacgaaaaaaataacacaaaaacaaaaagccctatccgaacttaatcagatagggctttcagattattctatcgctagatattatctcaacgggatatattgtacaaacgcctcgatcgcctcataagaagccaaacctaattggcgatacaactccgcggtagcacggttgcgatcttcggcacgctgccagaacaaacgctcgtcgtcacccagatacggagcgctctcggcctgcgattgatgcttcaaaatagcgttacgtttgaagcgcaactcctccggactgataggtacggccatctcaatatggtccatttcccattctgcccatgcgccgcgatacatccatacacggcagttcttcatccattcctcgtctttcacctcgtcgatagcggccagtacggcatccagacaaaccttgtgggttccgtgcgggtcagccaagtcaccggcgacaaacatttgatccggcttgatctcgagcaacagggcctttacgatatccttgtcgacctcactcaaatcattctttttcactaatccggtctcgtagaacggaagatccaagaaatgaacatgatcgtccttcacgcccgagtagcggcaaccgtgacgggcctcctcccgacggatcgttcctttcataaagaggacatccttccgctccggctcgccgttctccaccttctcgtaacgcaggtagttgatgatctcgttcgccttatccttcacggccgagtcgggagagtatttctcacatacatcacgcaaatactcgcaataacggattacctcctcgtcgcctacggcaatattaccggaagtctcgtaagccacatgcacatcatgatgctggtcgcacaaacgacgcaaggttccgcccatggagatcacgtcatcatccgggtgcggactgaatacgatcactttcttcggatacgggttagcacgctccggacgattggaatcgtcggcgttcggcttgccacccggccatccggtaatcgtatgctggatatcgttgaatatcttgatatttacgttgtaagcggaaccatataacgccaatagctcacccaatccgtgctcgctataatccttgtttgtcaatttcaagatcggtttgtccgtcaactgacacaaccaaacgatcgcacggcggatcaacttattatcccactcgcagctagtcaccaaccaaggatgactgatacgagtcaagtcataagcggcggaaagatcgatcacgaccttggcgttcggatgattctgcaaatagctggaaggaacggcatcgctaaccttgccctcaacggtcttagcgacaatgctagccttatcctcgccccaagccatcaagatcacgctgcgggcgttcatcatcgtagagatacccatcgtgatgatacctgccgggacattctcctgcgaagggaacgtacgggcagcctccttgcgagaagcgccttccaacaagaccatacgggtacgcgagctgatcgtcgttccacccacgttgaacatgatattgctggagttaccgatacctagcaacatgcaatcgatacctcccacggattggatcgtctcctcatactggcggcagaaatcaaggatagcgtctttcggcatgcttccgtccgggcaatagatattcgccggatcgatatcgacctgatcgaataactcctcttttaggcgagccagatttccggcactgggattagccaatggatagaactcatattccacgaaagcgatcacgttgcgaaaacttaatttctcctctttatgcatacggatcaactccttgtaaacgcttagcggagaacgtccgccgggtaaagcgatcacgaagggcttaccgatatcttgttttttacggatttgtgttgctatctctttagcgatagcgaaagaaccttcctcggccgattcataaatgtttgtcggaatcttttccaaacgggttaaaactgaatgctcgaaagcattttccgggcgataataccgcaacggtatacgcgtcagagtaatttgagaactaaggttcgttttcatgtttaattattgatttagtattacaatcttacttgaatcacaaatatatgaaataagtactgatttcgccatacgttgatagaacaaatttattaaccgaaaggtttgatctatatcgcctaaaaataaaaaaggaccgtcccggccagccaagacagcccctctctttattattaacgtgtttagaccaatgtatttgtctccggaactaagtttcccatgctccataccgcacgcacgttcaacttacgatccaagatcacgatatccgcatccttccctctttgcaaggttccggtgcgatcgcttacccccatcaggcgggccggagtctcggaagccatacggactgcatcggccaaaggaatgtcagccttctgcaccatcgtacgtaccagtacgtccatcgtggcgatacttcccaccaatgaagaatgatccgccaacttgcatacgccatcctcaatgataatgcggggatcggataacggcttaccctcgttggctgcgcatgagagagcgtccgtaaccaagcaagtacgttccactcctttcaacttatagaccaatcggaggatcgtagagggtaaatgacgcccgtcagcaatcacctctaccgtcatatcgtccatcaagaaaacactttccaccgttccctcgtacttatattcacgacgcttatggaaaccaggcatggcgttatagaaatgagccgcatgcgtgaaaccggcattgtaagcggtcttaatatcatcaaactccgcttccgtatgcgagatagcggataggattcccctcgacttcaagtattgggcgaactcaagcgcacccggtatctccgggctggaatcccagcgcttgatgcaatccgtgcgttccaatatctctttatattctttcgggtcggcgggattctccttatcgataaacaggctcgccgccatcttcggattcagatacggtccctcgatatgcaatcccaagatagggccgtcttttttcctcatcatctcctcgcatacggccaccgccttatcgatcaccccgatttccggagccaacacggtagggaatatcgtcgtggccccatgcttctgatgggcagctaccgcaccgtggaaagcctcttccgtacattcggagaagtcgaagcccccaccgccatggatattcatcgccacgaaaccgggaacgatcgacattcctttcgcatccaccaccttggcgccaatcaccgctaaatcgctatttgtaacctccaatatcttcccgtcgctaatcaatacggaaccatccttcatccatccttgcggcgtaaggatatggccatttataatctgtgtcaacataatcgttcttgcttagaatagtttattcgtaccttcaaccaacttacccatcgcccagaccgcacggacattcaagtcacggtccaacaagacgatatcggcgtctttgccccgctgcaacgttcccttgcgatcggatacgcccatgatacgggcgggagtctccgaggccatacgcacggcatcctccaaggggatctcggccttctgcaccatcgtacggatcaggcggtccatcgtggcgacactacccgccaaggccgagcggtcggccaacttacacacgccatcctcgatgatgacacggggatcgaaagcgacttggctatcactggcagcgcaagccaaggcatccgtgatcagacaagtgcgttccacaccttttatcttatagaccagacgaaggatcgtaggcggcacatggataccatcggccacgacctcgacggtcatatcatcgagcagatagatactttccaccgttccctcatacttatactcgcggcgtttatggaagcccggcatggcgttatagaaatgggtggcgtgggtataacctacctcataagcggtcaggatatcctcaaactcggcttgggtatgccctaccgaggcgagcacgcctttcgaggtgatatatttaccaaactgcatcgctcccggaagttccggagcggcatcccagcgcttgatacaatgcgtttcctccagcaaagggatatattcctcgggatcgggattcttgatgttctcagggatttgtccaccagccattttcatattgaaataatgtccttctaagtgaagccccagaaccgggctatctttctcggccatcagtttctcggtggtctcggcggcggcacggatcatcgggatggtagaagaggataaggtggggaagatactggtagtaccgtgtttcatgtgtgtggccaccgccgcacggaaagcttcctcggtgccttccataaaatcacggcctccacctccgtgcacgtgaatttccacgcctccggggacgatgtacatacctttggcgtctatcaaggttgcccccactaccgctaagtcgcagtttgtcacttctaaaatcttcccgtcgcttatcaataccgagccgtctttcagccagccttgcggggtaagaatctttccattaatgatctgtgttaacatgatatgtgttttaagctttcgcgtttctttggatagcaaagttaaggactttctttttaaaacgagtaagctattagaggttattttcaaagaataatcaaaatgacactttgtaatccgaacctccggagaatcgaatattccgggccctaagtacagctcgcctctaaatccgaaagaaaatttcagtaatcaactaatggccaacaccataccccaaaacagccttttattctagcgaaatcaattcatcctaattcatatcaaagggagagattggtatcatttatagggttacaatacggttctagcagggtaagaatgcctattcacgagtagtcataaccctattcttgagtagtcacgatgcccaacggcggcatatgcgtcggccgatggcagtactggcgtagcccaatgcggcctatcacgcatgggaaaagggatattctcccttttaaaagccagctctcgcactctctcttccgctatttcgcatcatcaacggcaagcacttgtcacgaaaacaggagtatttgaatcaaaaagatcagataagctgcctttcactggctagcagccttttcatgaatcctgcgtattcaactcttccaactccattgtccgttcggtccatagatccatcgcatcggaaagttctttttttagggcagaatattcaccgtagagagaagcgtcggaggcaccttccggcgtagccagcttcgcctcgataacggcaatgccattctcaagctccgagatacgggcctcggcctcggcaacagctttctccgctttcttaatcactttactcagttccttccttgcctcataggagagcttgttatgggatacctgagcctcaccggtaccggacatggaagtactcgtcccagtagaacgttccaattcacgcaagctatccattttcttatgctccaagaaattatagatgccgcctaaatgctcgacgactttctggttaccgaactcatagaccttatcgactaggccatccaagaactcacggtcgtgggaaaccacgatcaccgtgccgtcgaactccctcaaggcgtctttcagcacgtctttcgaacgcatatccaagtggttcgtcggctcatcgagaatcagcaggttgaccggctccaataacaagcggatcatcgccaaacgggtacgctcgccacccgacaggactttcaccttcttatcggaggcctcgccgccaaacatgaaagcacctaggatatcccgtatcttcaaacggatatccccttgggctacgtaatcgatcgtatcgaaaacggtaaggttctcgttcaatagctgcgcttggttctgggcgaagtaaccgatcttcacgttatggcctaattggagctttccggtgaaatcggtaatctctcccatgatacatttcaccaaggtagatttaccctcaccgttctttccgacaaaagcgactttatcaccccggttgatcgtaagcgtcacatgatcgaagatcagatgatcgccataacgcttcgccacctcctcgcagatcaccggataagaaccggaacggggagcgggcggaaatttcagccgcaacatggctgtatccacatcgtctacctcaatacgttccactttttccaattgtttgatgcgggattgtacctgtacggacttcgtggctttataacgaaaacgctcgataaacgcctcggtatcggccaatttcttctgttggttctcataagcgcgctgctgctgctcacggcgttcacggcgaagtacgacgtactccgaatattttaccttataatcgtagaccttacctagttcgatctccaaggtccggaaagtcgtattatcgataaaggcacggtcgtgcgacactaagatcacagcgttggcacgggtagcgataaagttctccaaccattggatggactcgatatccagatggttcgtcggctcatccagcagcaacacgtccggcctacggagtaagagcttcgccaactcgatacgcatgcgccagcctccgctgaactcagacgtcgggcggtcgaaatcgctacggctaaaacctagtccggccaatgtacgctccaactccgcatggtagttgtttcctcccatcatctggaaatgctccgatagatacgtgacacgatcaatcagcttttgatagccctcggagtcataatccgtacgctccgccaattgagtattcaagcgattgatctcctcctccatctcatggatatgctcgaaagcgcattccgcctcctcccgaaccgtacgggtatccaccaattgcatgtgctggggcaggtatccgatcgtgacctccttcggtacgctaacagttccagaagtcggcgattgcaggcctgcgaatattttcaacattgtagatttgcccgctccgttcttgcccaccaaagcgatacggtccttcttgtttaccacaaaagaaatatcatcaaaaagcgtaaaaccgccaaactccactgttagtccttcaaccgaaatcatactgtctctttaatttatgaccgcaaagatacaacagttcaaggtttactcacaaacttttcaattaatatcagcacatccttatgcaacggaagggccggatcggtataggtagccatctgtttttgctgatccatcgtatcgcaagtcttcatcagatggttcatattcccgatcaaatggtaatcggccgaaggttgagatcgcttcaatagttcggcgtcttttacggatacttgcatatccttatccccttgcaagatcaacaccgggacttttagtttcttgatgatttcctgcggattatacgtataccatgagatcatataaggctgtaccgacgagcggaacagggcttgcaaaccgatcggcacgtccggtacgagcttcccttccttcaaggacgtgtttatggatctcaccatattccggatcacttccggttgaccggccatctgttcctctatgatctcataagcgggacgccccgcacccgccaccgaaatgtatcctttcactttcggattatccaccgaagccgccataccgaccaacgctccctcgctatgccccaacacatagattccggagatccgtttgtccttgcttaaataatcgatccagcctcgtgcgtccttgatcccgtcctcgaaacgcatggaatactcatcctttccggccgaggcactcgaagcgataccccgcttatcataacgcagggaagcaatccccttccctgccagcccttccgccaaatatctcaaggaattattcttacccggcaaggcggcggagttcccgtccatatccgtagggccggagccggggatgatcaataccacaggataaccggactcctgattgggagttaccatcttcccttttaatgccccggtagacgtattcaacaccaccggacgctcgttcaaccgtacaggcaactggggcagaccagacaaggatacgagaagaaagcaaacgaaagctatcagtttctttttcataacggaatcaatttatatacttaaagcacacatgagacatacaatctcagtatccgccaaatgtaactaaaaaaggggaaaacctctcggccttcccccttctttatctaacatctttataggaaattaataccccggattctgtttcaagtttggattcttatccatgcttgtttgaggaatcggcaagtaacggttacgagaagagaactgacgagtctcaataacagccgtacccgtgatttccgcacgtttagtaggctcagactccccataattaatcgttcctgtaacacgtaacaaatcaccattcaggactttctcggcaagcatctttccatcttcctgccaacggacgatgtccgcacgacgcaagccttcgccggccaactctaccgtacgctcacgacggatcaattcacgaagtttatccttcgtcccatatttagccttatccacttcccgcattcctacacgctgacggatctgattcaaataaccatagatctcatcagaaggaccgctcaactcattcgcagcctccgcatacgtcaatagaacctccgcataacggaatacgatcggacaagctcccgagctccaaacatctccatattgatccatcggatccaagtatttcgcccaagtcaaagcactcttggaagcattatctgtataagtcgggaagttcttgttgacagtaccatcttgaagtttctcgtccaaagtattcaagacatcacctctccagtcacgtcccggatataaaatggtcatggccatacgagggtcacgattcgcgaacggatgctttgcgtcataagtcttcgactcttctttcgtcaatccatcagacatttcatacatatccaccaaattctgggtcgggacgatagaagaccagccttggtctacattattgtacatttgcccgatggttcccaatccatccaacgtctcaatattctgatccgctaggattatctctttagaatccactcccgataccttaaaaagattcgtataatccggatccaactcatactgcttcaaatcaatgattgccttagctgcgtcttttgccttttgccaatcaccataatacaaagcctcacgcatcttgatagctaaaacagcacctttagcgatatagccacgagcctccggagcctccgcgatcccagctaaggcctcgtctaaatccttagctatataatcgcgtacctcttgttccgtattgcgttccactttagcctcgtccgcacttgaataagaactaataataggcacaccaccataccaccaattcatcaagaaatacttataagcacggatcgctttagcttgagccacataattagcttttacagcgtcactagaaaacgtcaccttgtctacattctccaagaatgtattcgccttacgaatcgacttgtaatcataaaggatctgcccaggattagaactagacaatgacccatccccccacgggcggaatccttcccaagggaaattattatagcctatatctgagccacaatccagataaagcaacgtatttccatctagcaaatccttataacagcctactatgaagcccttcgcatccgcctctgtctgccatgtggtagaaggagccaactgatccttaggcaccgtatccagaaaatctgaacacgaagtagataacgcagccataccagccgccaacatatatattgataatcgtttcataaaatcttctatttaaatggtcttaactaattagaatgtcacatttacgccaaaagaatttgtcatcactaatgggtagctagacaaacgggaactaaccgtctccgggtctacgttcaatggcatagaatctatcgtaaacaaattctccgcagaataataaacacgtacattcgacaaaccgatagcgttcagcacactctttggaagcgtatatcccaattgcaatgtcttcagacgcaggtaactggtattaattacccagaaatcagacatcacgttagaagcctcactcggagattttctagactccgctacacgcggcatacttgcattggtattttccggtgtccagctatccagccatgcagtagaaggatgtccggcactacccgagaactcaccaaacgcttctttcgtaaacgcacgacctacattagccgcaccggtgaagttcaaagtcaagtcaaatgctttatagcctacattcaagttcaaaccaaatgtaacaactggattgatagtcttagacaatacacggtcatccgcatccagctttccatctccattcgtatctacataacgtaaatcaccggcttgaaaatcctgtccgaacgggtagccgtcttttcctttataggtatccatccattgctgtgcctccgcgtcagattggaaaaagccatcagccttatatacatagtaagaatcgattggctttccaacaaaacgccacaaatcaccgtcatcaggatttgtcatacggtctacacctcctaaatcctcgatcttgttcttattataggccatatttcccatcacattcaatgaccagtcattccacttattgttataacctagctgtacctcgacacctcggttacgcatagaacccacgttgtcgaaataaggatccaagccaaactcagtcgggaccggtacctccatgatgatatccgtagtcttgcgatcatagtaatcaaacgtgaaagtcacatgattaataaccgcatccaagccaataccccaagtcgtagatttctcccatgacaaatcctcgatacgataggctttctgataatatcccgtcgtcaagttgcctcccataggataattaccatccaaattataagtctgcatccaaggataatattggttctcccaaggattcgatttatttaaggcgtcttgattacctaacataccccaagaagcacgaatcttcaaactgctcaaccaatcatgcgtactttccataaactcctcctcgctgatacgccaagcaccggagaaagaagggaaatatccccaacgatgtcccggagcaaaacgagaggaagcatccgcacggaagtttgcctctaataaatattttcccgcaaaatcataattaatacgcccaaaataggaaagcatggcaagctctcggctcaaaccatcatttgtttgtgtagaagccccaccggcatccatatcattcaggctattactcgggaaattattcctctgcatctgattcttgctaacctcatacttctccgcatgataacctaccatcactttcaagccatgctgaccaaagttcttgctgtaattcagcaaagcatcgaaattataacgtttccaattcacgaaacgttcaaccaaggaagtggtacgagacgcagatgccggatcatccggtatgctcagaactcgctccgtatgacgttggtcctcgttcacataggcacccgtcacagtagccttcagcccatcaataatatcataatcaacagaaagtgcccccgtaaaattctggttacaattatccaccgtctgcccggaatccaaccatgcgatagggttaccatcgttagtttgtccgtatttgccatccttatctttgactgggatcatcgggctaataatattcaattgacggataatctggtcggaagaaccaccataatagctagcattcggatccgagaagtcattcttgataaaagacatgttcatccgaacagccagtttcttcgtcaactgcatatccagattcgtacgtccattaaactgtttacgatctgagttaggaaggatacccgtctgccctaaatatccggccgaagccatatacttcacgttctccgcacctcctgtaatactaacattgtgtttatgcaacaaacctgtccgataagcctcatcattccagtccgtattaggatgtccgtaaggatcagagccatcctcaaacatccggatgtcctcgtcactataacgtcccggctcgaaacgattccacaaacgtgcgtaatcggctgagctgacacgatcaatcatggaagtagctttcgaggcacccacatatccgttataagagatacgaggagcacccgtcttaccacgttttgtcgtgatcaagataacaccattagaagccttcgaaccgtaaatagcggcggaagaagcgtctttcaatacagaaatactctcaatatcattcggatcgatatcattcatggagccactctcgataccatcgatcaagatatatgggctggcagagttcaaagtaccgacaccacggatacggatcgtactaccatcctgtcccggacggccttgacccgaggtaacggttacacccggcatcataccttgaagaccggaagacacgttggagataggacggcttgtcaactccttgctatccaattgggctaccgctcccgacaagttcgccttctgttgcgtaccataaccgacaacgatcacctcatctaatttctgggtatcttcctgcaaggatacattgatggaaggctctccattatatttgaattcttgagttagataaccgataaaggatacttggatcacatcccctttcttcacatccaacacgaaattaccattcatgtcggttacagtaccattcgtagtaccttttacaactattgacgctccagccacagggccaaaactgtcactaaccgttcccttcaaactaccttcttgctgggaaatacctaccctcggagttatcgccgcacgatcagaagcatgaaccacacccccggaacaaaacgctgcagacaatagaacaaaactgacaggtcttacaattttcaacataagaatcgttttttgtttattaaatagctgttactattataagacttaaggcatactattttagatctcgtttcttataatattcactcttctaaatcattaatgtataattataaatcctcggttaactaccatgaaagcgcttcttcatcgttctggcggaactccgtttattactcatatacactaacttcatgtttgaatttcaaaccatatacctctttgatgtccatagctccatactaaaaaagattatggttgaaaagattgtttgttaaatattttaataattaggtggtgtcgttttagattcgtatgcgaaaaattagtcttttttgttttataattaaaaatagtgctatatttgctgcgtctaatgattataagttccgccagaactacgtacttatagaagcctgactaatattaaggcacttattccatttattcctttataaccactatttatcatgaaaaagttgttatcttcgtcccttgtaataactaattattaaattatgaaaaagaaaagcttaactttattactagcgactacggtggcaagtagtatcctattttcgtcctgtataggatcttttggtttaacaaacaaacttttaacgtggaatagaagcatcgacagtaagtttgttaatgagctagtgttcattgctttctggattgtcccggtttacgagatttccgctttggctgatgtccttgtgatcaactctatcgaattttggagcggaagtaatcctgtagcggatgtaggtaacgttaaaacaatcgatggtaaagacggcgtttataccgtagaaacaaaagttgatggataccatatccaaaaggaaggcgatgagaaagcggttgacttagttttcaacgaggctgaccaaagctggaatgtagaagctaacggagaaagcacaaaattattaaaattcaatggtgatgacgaagttgtcatgtatttacccgatggcaaggaaatgaatgtcgagctaaaccaagcaggtgttttagctttccaacaggtagctgacggatattcttactatgcagctaaataattgaaaattgagaattgaaaattacgtagagtcacttctaattctcaattctcaattttcaattccccagtgctaatctaaataaaatacgatgaatatgaactctatcaaaaaaatgatgctttccggagcattaggttgccttatttccggaatggcttatgcggacggttcttcaccccaacccgtaaaaccttattggcaagacattcaagtcgtagccgtaaacaaggaaaaacccagaagctccttcatgagttatgcggaccgagaaaccgccctcacctctcgatttgagaaaagcccgtactattccctattaaacggtacttggaaatttttctttgtcgactcttacaaagatcttcctcaaaatatcacagatccttccgttaatacctcttcatgggatgatataaccgttcccggaaactgggaagtacaaggacatggcgtagccatttatacgaatcatggttacgagtttaaaccaagaaatccccaacctccgttattgccggaagcgaatccggttggcgtataccgcagagacatcgagatacccgcaagttgggataaccgggatatttatttacacatcggcggagctaaatccggcctttacgtatatttaaacgggaaagaagtgggttatagcgaggattccaaaaatcccgccgagttcctgatcaataaatacctgcaacccggaaagaatgtgcttacattaaagatattccgttggagcaccggttcttatttggaatgtcaggatttctggagaatgagcggtatcgaacgtgacgtattcctttggtctcaacccaaggccagtattcaagatttccgtgtcgtctcaaccttggacgatacgtatacgaatggaatcttcaaactggcggtagacttaaagaatcatacccaagaaacgaaaaatttaaatgtcggatatgagcttttggacgcaaaaggtaatcttgtgacctccgaggctaatgatatatgggtaagtcctgcaagtcctcaaacagcatctttcgagtatgatttaaagaacgtagccccttggagtgccgagcatccgaatctatacaaattattgatgacgataaaagaagagggtaaggtaatcgaggtagttccattcaacgttggtttccgccggttcgagatgaagcaaattgaccaagtagcggaagacggaaaaccttatacggtcttattgttcaatgggcaaccggttaagttcaagggtgtcaatattcatgagcataacccggaaaccggacattacgtaaccgaggaactcatgcgtaaggatttcgagctgatgaagcaaaacaatatcaacgctgtccgcctatgccactatccgcaagaccgtaaattctatgaactctgcgacgaatacggattgtatgtttacgatgaagcgaatatcgagtctcacggtatgtattacagcctgaaaaaaggcggcactttgggtaataatccggaatggctgatcccgcatatggaccgtacgatgaatatgtacgaacgaaacaagaattatccgagcgttactttctggtcactcggaaacgaggctggaaacggatacaacttctatcaaacttatttatatctgaaagacaaggaaataaatagcatgaatcgtccggtgaactatgaacgtgccctttgggaatggaatacggatatgtacgtacctcaatacccgagcgctgaatggctagaggaaatcgggcgtaagggtagtgatcgtccggtagctccttcggagtattcacatgcgatgggaaactcttccggcaacttatgggatcaatggaaagctatctataaatacccgaacctgcaaggcggattcatctgggactgggtggaccaaggtatcttggaaaaagataagaatggacgtgaatattatacctatggtggtgactatggagtaaacgcccctagtgacggaaacttcctttgcaacggtatagtaaacccggatcgtaccccgcatcccgctatggcagaggttaaatacgcccatcaaaatatcgggtttgaggcgatcgatttagcgaacggtttattccgcgtcacgaaccgtttttatttcacgaacctaaagaaatatatggtccactatagcgtaacagccaataataaagttgtacgctccggtaaagtctctttggacatagaaccccaagcttctaaggaatttacggttcccgtaggcaacttaaagccacaagccggtacggaatatttcgtaaacttcaacgtaacgaccgtagaaaaagagccgttaatccctatcggacacgaaatcgcttgcgatcaattccgcttaccgatcgaaagccccaagaaggcgtttaagaccagcggccctaaattaacggtttcgacaaatggagataacttatcggcatcctcctcaaaggtaaacttcgtgtttaacaggaagacaggaatcgttacttcttataaagtggatggtacggaatatttcagcgagggtttcggtatccaaccgaacttctggcgtgcgccgaccgataacgattacggaaacggtatgccaaaacgcttgcaagtctggaaggaaagcagcaagaacttcaacgtgacagacgctaccgtcactatggatggcaataacgccgtggttaacgtgaactatttattgccggcaggaaatctatacattgttaattatacgatctatccaagcggagccgtaaatgtggccgcccgtttcacatccacggatatggatgccgcccaaaccgaggtatcggaagctactcgcacggcaaccttcactccgggacgtgacgccgcccgtaaagaggcttccaaactaaacgttcctcgtatcggtgttcgcttccgcttaccggcaagtatgaatcaagtggaatatttcggacggggacctgctgagaactacttggacagaaacgccggtagtatgatcggcttatataaatctacagccgaggaattatatttcccatatgtacgcccgcaggaaaacggtcatcataccgacactcgttgggtatcacttagtaccggcaagaaaggcttgttgatccaagcggataatacgattggatttaacgctttgcgtaattccatagaggatttcgatgacgaggaagcaactgggctaccccgtcaatggagtaatttcacaccagagcaagtagcgaaccatgatgaagccgcagcaaagagcgtattacgtcgccagcatcatatcaacgatatcacgcctcgcgacttcgttgaggtttgcgtcgacttgaaacaacaaggtgtagcaggttatgatagctggggttcacgtccggaaccagcttatacattacccgcaaaccgggaatacaactggggctttacccttattccgcttaaataaagaaaagtcataacttatccataacaaagggagtgtattaggcttaatccaatacactccctttgtttatactactgcaacggctttgcagcactactgcaaggcgggttgcagtaacgtatccttatttaatcacttccttcaaggtattctgtaagtcttctccagtgatattcttggcgatgatcaccccattcggatccaataacacatttgccggaatacctcgtaccccataaagagcagggatctcagaatcccaatatttcaagtcggaaacgtgagcccaagtcagatgatcatctgcgatcgctttctgccatttagccttatccttgtccaaggatatacctacgatcgtaaagttcttatccttatattgctggaaggcatttaccacgttagggttttccttgcgacacgggggacaccaagaggcccaaaaatccaataacacatattttcccctaaagtccgacaatgacacagaaactcctgcagtatccggcaaggaaaactccggagcgacttgtccgatctgtacgtgttctaattgtttgataataccgtccaagtccttcacataaggactattcgccaataccggggaaatcttcgcacgagtcgccttcaaatcatccaaagataattggtaggtaaaataacgatatagatagaacgacgccgccggagaatctggatatttcgaaatcaaactgtcaatatcatacccttcctcaaataccttctccgcattttcttgaaagacatcattcaccggtgaattctgtacggtaatagtctccccgtcattcccgatcttgacattcatatccgtattctccaagaaaagttgaaccggatagttcatgctctcggttgccaaaccgaatagtaaaggctgatctacctcacctttaaaggtgaatttcccatctttgatctccgccgtatccacgtcaaagaacattttattacggaatgacttcaagtaaattttaccgtcgggcatattctctacctcaccattgataacatatccttttggaacttcttggcaaccaaccaccaaaaggccggcaagcgccatcatacaaaattgcttcatttctctattctatttattgattacttaaacccagggtgatgataacgtccctttttcaacgagatcttaccatattctatcgcacgcaccgggcaacgatgaatgcaggcaacacactgaacgcaagaatcggcccattccggttttccgtcacccgacagggaaatcgtaccggtcggacagaccttcgcacagatgccgcaagagatacaggcatccgtagcataaaatcggttgccgcctatcgcaaagtgagtgaacaacggatagaccatatagctcttcaaaagagggacacttcccgcataatacaaagagggatttctcttctgccggatcgcctctacgatctcgcctacacgttccggcgctttttccagtttctcagtctctaccatcttactatccacgtcgaagccgggcatcaagacataattgttcggcatttgtacagagaatcctccggttacggcaattccccgcctcgccaagatgctccgcatgatccgatccgtatatccacaatcatcaccacaagtacagacgaaataaacctcttgccccttatatccggacaggatcaaccgggaaataaagcggggcaccaatacagccggcccccaagaatggacagggaacacaaaaaacactttctccctctcccccaatggataagcattcttaccctcattcaacgcatcggcaatggaaaccaacggctcatcgaaagccgtccctaacgcttccgcaacccaacgggagtttcctgtccctgtaaagtagaatatcatgcgctcatttttttagatacaaaaatacataatatccaaatatatacgctatctttatctagtttaagaaacctaaaaaacaaatcttatgacaacgatggaattaaatttacggaaagaatatctctatgacttgataaaaggcatggatgaggaaagattatcgaaagtggagacctatataaaacgtttgtgctctcctacttccaaaaaggcaacgaactacccttggacgccatcggtagaagaattagaatctatgatagccgaatctgaagaaaactatgagaagggactttatatagaggaagaagagatgaataagttttttgaatcgatgagatgaaacaagccattacaaaatattgtattgtatagaaaatgatgatttcatccacattgtagtcgttttcgattgcaggcaaccccccaataaataaatatcttttttcaaataaaaaaacagctatatcaaaagtattataaccggacgttggtttcacagaaaaacatctatttgtaaagtctacgttaccaacgcccgattataaaaacttacactcttaggagatgatcagatctcaatatcccaaaaacccgccgaacgttctaattcgaccaaggctgagctgtaattaaacagcgtctcaatatactgagcttgtacttcatcgtaagtacgctgggcgtccaagacttccaacaaagagacttcccccctattatagctgtaaatcttgccatccatcacctcacgggcttgccttaaaagcccatcctgataatgattgacttgctcggcgaaagattgataattgcgatatgcctgcatcacctccgtctgcacttgcaaaagagcctgcttatattgcgcttccgcttgttgctcccgataacgagcggcacgaaccgtccccttattgaaattagagaatttcaaaggaacagcgatacctgccgtcactccggtaaaaggaggcgccggggcttcctcattataaacccgggcattacggcttacggcgatagacaaatccacatccgtattccgctcccggcgagctactttcaaggctctagcggccacttccttgttttttaaggcagctaccaaatccgtacgcccctcgcttgccgccgttattaagtcaacaaggataaaattccgaggctccatacgtaactcggcctctgggtgaaataaagtatccatactgaaagtccccgtcaagaggtttaagttcgagaaagcattctttaattccgcaccggcttgcaacaactcgttccgcaagaccccggcctccacccggctctgcgtagcgtccacctcacggatttgccctaaagagaaacggatactgtcgctctccgccaatgcccggatattctcataggcattctcctttactttatacaactcatgttgctttaaggcttccatataggcaatcgtagcgtctgcccggagattccggaaataatcggccaacaatgcctcggtcaactcactctcgctacgtgccaatgagatattcgcaccccgtttcccaaaagagaaagttttgctcagttctacctcaacaccttctcccatctgcaaggaattattctcattattgaaataagacacggaaagattcggatcgttaaacacctttgccgccgttacctcggccttagcggccggcacattcaatttctccgacacatactcaaggttaccttccgcaacccgctccatatattgccgatacgtaagcggaaccatggtctgggcattcgcggataagcatccgcagagtaacgacaggattatatatttcttcatatcttctaatctaaacatagtacatctttttaattccaccgccggattaagcgtgcagctctttttcctccgataccggcgtcaaatccttcccctcataatgcttctcgatcatatagtataaagcgggaagcacataaagcgtgattaccgtagcaaataaaagcccgtaaacgattaccgtagccaagggacgctgcacgtccgaaccgatccccgtactgacagaggcaggaagcaatcccaagaccgcaaccgtagccgtcatcaagatcggacggaaacggtgcttggttcccgttatcaccgcatctttcaaatcccgctccctcgtacgtaagttattgatatgggaaatcatgatcacgccattttggatagcgacaccgaccaaggcgataaaaccaaccgccgaggagacattcaatgtcattccccgcacattcaacgccaacataccaccaaacaaagccaagggaacgacactcatcatcaaagccgcctgccggaatttaccgcaagccgcaaacaacaaaagcagcatcagccccaacgccaaaggaaccacagcccccaaacgggcatacgcacgatgctggttctcgaactgtccggcccatttcaaatgcacggaatcatgatcgtatttcacctctttatcgatcaacgcattcgccttattcaagaacgccgtcaagtccacgccacgtaaattaacccgtaccgtcaagtgccgcttattcatctcacgggtaatcgtactggcaccagttgtcatcttaatctccgctacttgcgaaagaggaatctttgttccggaaccggtagtcagcaatagatttccgatacgttcgggagaattgcggctagcgtcatcgaaacgacaaatcacgtcataacttttacttccgacaaatatctgggaaatagaagctccaccgatcgctaactcaatcaaatcagccacatccgacacgttcaagccatactgggcgatacgggcacgatccgcaataatctgcaattgcggcaacggaggctcttgatctaccgctacgtcggcagcacccggtatttccttcaacacattagcgacttgatccgcaatatggcgactttccgtaatatcatcgctataaatcttcagcgccaaatcactatgagccccagcgatctgatccatcaccatatcgatgatcggctgggagaaaccgaccgagtagccgggcatggtctccaacttagccgccatttcctcgatcagatccgctttcgtcttaccgaatttccatgtactatagggtttcaatcccacgccacactccacatgagagagtgagaacgcttccgccccctcatcatcgcgaccgacttgagtcattacatatgagacttccttaaactctttcaaagtcttccgaagctccgcccccatctccttcgatttctcaatggaaatacccggaggaagctgtacctgtatccagatcgccccctcatccaacggaggcaagaagtcttttcctacggtataacttaaaatccccgctcccagcaatatcgccagtaacggtacaataacccgtcttggcttctccatcaatcggacaatttgtgaatgataagccgtggaaagtttctccaaccaacgattatggtaaatctttcccggcttacgatacgcataaaaggccaatcccggaatcaagaacaaggccacacacaaagcgcccagcaaagcataccctacggtataagccatcggcgtaaacaatttcttctcaatatgctcaaaagcgaacaaaggaagataggctgttataataattaatgtagagaaaaagatcgggcgagccacctcagtcgtacggcgcaagatcgaatcttccgtcaatacctcatccggatgccgttcccttttcttcaagaccgtctccatcatcacgatcgctccgtctaccaaaataccgaagtctatagcgcctaaggaaagtaggttcgcaggaatattcgtaacatgcatcaagataaaggcaatcaatagagacaagggaatggttaaggccaccaacaaagcgccacgccaactccccaagaataagatcagtactaagacaaccaataccataccctcgaacaacgtatgcgatacggtatgcaaggtcgtattaaccaaatccgtacgatccataaacggatggatacgggttccctcgggaagtgtctcgttatttagttcgtctaccgccttatgcacatcatccaacacccgggacggattctcccccctgagcatttgtacgataccttccacgccatcggagtaatcacgggtatcgtccgtaaaacctaaaacgcccttacgctccaagtttccgtatttcagtttaccgatatcattcaagtagaccgggacaccattcactgtcttgatcacgatatgccccaagtcttccaagtccttaaccagaccgattccacggatcacataactcaaatccccccggcttaacatactaccaccggcgttcacgttattcttctctatcttttccgtaatatcccctaaggtaatgtcgtattgctccatcttataagggttcacctcgatctgatattgggtagtgataccgccgtaattacttacatccgctacacccgtaacctgtttcagtctcggaataattacccatttatgcaaatcggtcaactccctcaagtctaaacggtcactttccaccacataacgaaagatctctcccgtcggcgaagtcaaaggatttaagccgggaaccgcattataaggaagctccacgtctaccaaccgctcttgtacacgttgccgggcccaataatcctcaataccatcatcaaaaaccaatacgaccgtagataaaccaaacgtattcttgctacgcattacgtttagtcccggcagaccattcatagcccgctcgatcggaatactgatttgttgctcgatctcctcggcggccaatccgggaacctgcgtcacgacttgcacggtggtatcggcgatatccggataagcatctatcgccaaccgcatccaagaataataaccaacgatcgctaagaacagaaataacacgaacatcagtcctcgccgatgtatcgccaagtaaataatccttttcataatccgttagcgtgcgtcaagtaaataaaacgctcccgtaactacgatctcgtcacctacattcaagccggataaaaccaccgtcttgccatcttcagtatggccggtctcgatcttttgtttccggtaatcgttattccccaattccaccaatacgtacatgttctcctcttcctgcaagatagcggaagtaggtatacggatcacctccgcctcacggtcgctcagcttgaccgtgccgtacatctccggcttcatcaaacgggtactgttatcgcactcgatcaagacctccaccgaacgggtatcggggtccagcatctcgctgatgtgataaatctttcccgatatcggtttatccggcatggctaccaaccggatttccacctcatccaaagcctgtattaaactcaaatccttctcttttacatgggcgaccacccataccttgctcaaatcggcgatgacagctacaggctcggcgtcctctttcatatattgcccgattacgatccgatctttcacgacctcaccggctataggcgagcgaacgatcaatggttgccccaaagccatttcatccggattaatctgaaagactttcaatgccgctaccatattctcatagtcttttttctttaactcgtaattcacctcggcctcttccaattccttttggacaccaaccttgtttttcatcaagtctttctcccgattcaagcttttcaaggccagttccatctcttggtaagcttggtaataagatttccccgcctcataaacagcgggagcgctaatctcgaagatcggactacccggggccactttttgccctaagcgaacgaacgatttcgtaattcgcccgcttacaggtgaagccacctccgcataattagaaggaatcgcctgtacgacccccgaggtggtaaactccatacggtaaggttcctgtttaaccgtttcctttgtcaacttggataaaacaggagattcggaaccgatatgtataatatctcctttgagtgttacggcatgcgcagactcatcctcttgcttttgggtatggcaagagcataatactattgctggaagcaatagtaaaaatatagatttcatataagatgcgtaaaatgtttagtataaaaagtgattctaatgcttgattcaaactactataccaaacgagggaggcgcacgggattcgccacgccgcacaagacgcaagacaacctctttctttagaaagacgagcactaccatcaaaagcgcccaagccataaccaaaggtaagtacggaattaactccagacacaattcggtcagctcttcaatcgtattaaacgctaccgtactatgctcatgatgaggcaagccgtcggctcccggcagatagggatgagagtgagtgatactagagtttaggaaatgatgcgtatgggtaaaggccgtgccacccacgtagtaactcataaagagtactaccaagaggggtcttaaccacttcaagctacgcattgttttcattcgccatctgtttacttcgcaaagttataaaagaaactgccatttcatttgcaataagtcaaaatttattcctttatttgcatacactgaataataaacagtcatatcaatgaaataaacactactttatgagaaaaatcttacttgtttgtgcggcattagcctgcatgacagtctcccctgtaccagctcaggacgctgccgtaaaaaaaatcatcgagatgggtcagaacgataatcaagtgatgcatcagctggatatccttacgaaccgctttggcggacgtttaatcggttccgacgcttatgagaacgccgccgagtggatggtgcgtgagtttaagagttggggactcgatgtccaattagaagaagccggtaccgtccctgtcggctttaatcgaggaccttggttcggacgcttgttgagcgacaacggaatgatcctgcatttcgccaccccttcctacacttccggaacgaaaggcgtgcaacgtgggcatgcggtgatggagcctcgtaacgacgaggagttccagcaaatcaaaggaagattgaatggtgcttgggttcttatctcagggaaaaatgtaggttggcctatcgaccgctccgcctcgggagattccatccgtgcggagatcaagaaagagaacaacgagatcatgaagaaaaacaatgatctaagacgccgcaactgggaaaacggggagaaaaacgagatgttgccttataaagaattccccggattatattataaggaaatgtgcgaggccggagctttaggttttatccaatcctccaccgtacctatccgtgcgttatacgaccggaaaatgatgaacgacccgaatacgaacttcgacaatctgccggaacttccggatatcaaattagacgagcatcaattcgcgatcatcgaacaaatggtgaaagagagacgtacattcgaactagagttcgatattcgtaatcattttaaattaggcccggttaaataccataatgtcgtagcgtctatcaaaggcagcaaatacccggacgaatatgtaattatcagcggtcacctagatgctttcgacgtggctaccggaggcatcgattgcggtactggaatcggaccgatgatggaagccgctcgcatgatcgccaaatccggagccaaacctaagcgcacgatcttatttatcggattcgccggtgaggaatttggcttattaggagcacaagcttgggtgaaagcgcataaggataaattacccaaaatcgctaatttgttcaatcgtgacggaggcccggaacctcctgtcggtatctccgtccctcaagccatgtatgatgatttcgtgaagatcagcgaacccatccaaaaaatccgtccggactatcctttcgaggtaaaagttcgtgaaccccgtaaacgcccgacacgcatggggggaacagacgcatcagttttcgccatcgaaggtgtccctacattaggtttcaccacagaggatttcaaaggatatgattttgattacggcgaaatctggcatacggaacgggatttatacacaaagaacatccccgaataccaagaacatacggctactgttaccgctatcatagccctcggtgtagcgaatctggataagcaattatcaagagaaggtttatataccgaagagtaggtcagcacgatcgctattataaggagtttacaatgcctattgtaagctccttatgatgggcatcataaaagacttacaatgcccattataagaaatagaaaaaggatatgccctaataggcatatccttttctcattctagggtgaaagatggggctcgaacccacgaccctcggaaccacaatccgatgctctaaccaactgagctactctcaccatataaaaaaaactttcattcttcatagacgccttggtttataaaaccttgttttattcataacaagatttttatctaaaaaaccacaatgggtgaaagatggggctcgaacccacgaccctcggaaccacaatccgatgctctaaccaactgagctactctcaccatatccgcctttcaaaggattccccctttaagacggcgcaaagataggtataaattctgattacacaaaccttttgcgaacttttttatccatccacttacttatagatcgctttctttcccgctaacaatgtgttacgcatcaaagaaatgattgtcataggccctacgccacccggaaccggagtgatataggaacatttaggagcgacctcattaaacaagacatctcccgttaacttaaatccgctcttggttatgctgcttggcatacgggttgttcccacgtcaacgatcacggcgccttccttcaccatatcccctttcaagaattcaggaacacctaaagccacgataataatatcagcagacaagcacatctccttcaagttcttagaacggctatggcatacggtcaccgtacaatcgcccggataagatttctgcatcatcaaggtagccatcggcttgccgacaatattgctgcgtcccaaaaccacgcaatgctttccttgcgtctcgatatgataacgcttcaataattccaagataccggcaggcgtagccgatacgaaacaaggtaaaccgatagacatacgtcccacgttaatcggatggaaaccgtccacatctttacgataatcgatcgcctcgatcaccttctgctcggatatatgtttcggaagcggaagctgtacgataaagccatccacatccggatcattatttaactcatcgaccttacgaagcaattcttcctccgtaacatcctcctcaaagcgaattaaggtagacttaaaaccaatctcctgacaagtcttgactttactagccacataagtctcgctaccaccgtcatggcccaccaaaatagcggccaagtgagggatcttacctccggcagccttgatctgggctacctcctcagccatctccttcttcatctgagcggaaacggccttaccatccagcaattgataatgttgttcttccatattattgattgtctcctgttaattaacgtctgaacgagggcttcatcgaaggtagcttcatcttccccgactttgcggaagtaagcatacgcatcatcttacgggtctcatcaaattgcttgatcagcttgttcacctcctggatgctcgtaccgctacctttggcgatacgctgacggcgtgagccattcaagatagccggattgctacgctcatccggagtcatcgaataaatgatagcctcgatactcttgaacgcgttatcatcgatatccacgtctttcaatgcctttcctacgcccgggatcatggatgccagctctttcaagttacccatcttcttgatctgttggatctgggagataaagtcgttaaaatcgaactggttcttagcgatcttcttctgcaagcgtttcgcttcttcctcgtcatattgctcttgcgcacgttccaccaaagacacgatatcacccatgcccaagattcgatccgccatacgttcagggtggaaaatatccaaggcatccatcttctcgcccgtaccgacaaacttaatcggcttatcaacaaccgtacggatcgacaaagcggcaccaccacgggtatcaccatccaacttcgtaagtacgacgccgtcgaagttcagccgctcattaaattcccttgcggtattcacggcatcctgacccgtcatggcatctaccacgaacaaggtctcatccggctggatagcgctcttgatagcggcgatctcgttcatcatctgctcatcgatagccaaacgaccggcggtatccacgatcacgacgtcattgcctttagcccgtgcctcgcggatagcgttcatagcgatctccaccggattcttattctccaattccatgtataccggaacacctacctgctctccgactacacgcaactgctcgatagctgccggacgatacacgtcgcaagcggctaataatggtttcttatttttcttggtctttaataaagacgctagtttacctgtgaaagtagtcttacccgaaccttgcaaaccggacatcaatataatggcgggatttccctgcaaattcacgtcaaccgccgtgccacccatcaagctggccaactcatcgtgaacaatcttaaccatcaactgactaggcttaaccgatgtaagcacgttctgtcctaaagccttctcttttaccgtatccgtaaaactcttggcaaccttataattgacgtcggcatccaacaacgctttacgcacatccttcaatgtttccgccacattgatctcggtaatcttgccttcgcccttcaacagtttaaacgatctgtctaacctttcgcttaagttctcaaacataattcgtatgtgtatttatattattttctactggattaaggggcaaaggtacgaaaaagagatgagtatgcgatgaaagcgatctcgaaattcttcacttctcaacgttttagtatacggaccgaattaagaaccgccagcagagacacgcctacatccgcgaaaacagcttcccaaagcgtggcaaaaccgaaggctcccgccacaaggactatcaccttcacgccaatagatcccacgatattctgacggacgatattccgggtagcacgtccgatagaaatagcttccgctactttagagggctggtccgtttggataaccacgtccgcgctctcgatggccgcatccgatcccaatccacccatcgcaataccgacatcacttaaagccagtaccggcgcatcgttcatcccatcgcccacaaaggcaaccgacttatccgtctccgccgttaatcgctctatataagcggctttatcctccggcagcagattaccatacgctttatcgacacccaaacgctcagcgaattgattcacgatctcttgcttatccccggacaacaagcgaatatctttaacatccagatcctttaaccgacgaatcgcatccacggcatccttcttcaaggtatccgaaaggagaagatgccccgcatatttcccatcgatcgcacaaaccaccacggtagaaacactatcggataattccttcgggacaggaatatcacgttcggccaataaacgaatgttaccgacaagcacctgccgaccgttcacgatagcctcgacaccatgccctgccaattcccgcatgtcagtgatttccatcggcacgctatcttgtttttccgcatagcgaactacagcctgcgctaccggatgggtacttttccgctctactgataacaaaatactcaaaagatcagaaaccgggatctccgtgctttccaccgttgtgacctcaaaacgcccggtagtcaatgtaccggtcttatcgaacgctaccgtatttacccgtgtgatcgcatctaaataattaccgcccttaaataatatcccggcacgagaagcggcgcctataccaccgaaatacccgagcggaacacttataaccaaggcacaaggacaagaaataaccaagaaaaccaatcccctatataaccaatccgagaaaacatactggaaagaaggcgtcaccatccctaccaaggctggaaccgacacgattagaaacgacagaagaatcacgattggggtataaatccgtgcgaaacgccgaataaacaattccgccggcgctttccgctccgaggcatctttcaccaaagccaaaatacgggccaaggcactttgctcgtacggccgattcacttgtatacgtaccgcctgcccctgcacgatcattccggcaagcacctcctcaccctcacggatagaacgaggcatactttccccggttaatgccgaggtatcgaactgtgcctcggcttccaataaaacgccatccaaaggcacacgtccgccgggtttcacctcgatccgctcgcctacttttacatccttcggagatacattcatatatgtacccgtccgccatacatccgttcgttccggccggacatctaataagtcactgatattcttcgaggctttattcacggctagaagttgcaacctctctcctaccgtatagaaaagcatcacggctacggcctcgggatactccccaatacaaaacgccccaatcgaggcgatcgccattaacgagaactcactaaaaaagtctttccgcaaagccgcttcccaagcttctcgcataacaggaagtcctaccggcaaaaaagcgaccagaaaccaaatggcctctatccaagactcagcaaaccaacttatccccgagtacttcccgataagtcctatcaccaacaaaacgaaagaaaccgtcggcatccataaaccggaacttccgtgcgaatggcaatgttcgcatccacatgttgtactcataatcttatctattttaattatttacttcttgattacggtacaaaggtaagagaagggagttgcaacttgattgcaaattatcagggtttctaggaacgtcgcttattacacaatgggcaaacaccctttaccgtataattaatggtatccattatatatccttccggcaattgagcgaccgggatcttgatattattcaaacaagaggttttacggcatacctcgcagaaaaaatgaatatgcctatcacccactgggcatgtctccgaacggctctggcatatctcatattttatagagccactaccatcttcgaaagaatggatcgcatgatgttccaataacaaggccaatgaacgggaaatggtcgatttatccaacgtctccaactccgcctccaattcgaacagggaagccgggctggttcgttctgataatttttgcaagacaaggatccgtgcggcagtaggccgtactccttttcctaccaacatatcttcacattgcttcgtggacatgagttacctttcttatttgattacaatacaaaaatacgaacaatttcccaatattcacagttcaaaaaaagacgtacgtgtttttcagaattcacgtacgtgttttcgaaaaaagacgtacgtgtttttttcccctcatatacttatattctcttattttgccaagaggctttctttaaatagattacgctagcgacgagcaatccactatagtaaatagcctctgtcaagaagcatacggctaccgacaaacgcaaacgtatccccgcgacatatacaaaaagcacatacagaatcaataccgccacttccataaaaagcgcagaacgtgtatttcccgtacccgacaccccgttgaacgccacattagctaccgatccgatcaataaagaaccgacaatcacgtagacggatggaaccgaggccgccactaatgaagcgtcattcgtataaacagacacgacccatcccggcatcaaactgacaatagcggcaaacacgaccataatgcccaacgataacttacagatcttccagatagtcggtataacttgattgatcgctcccgccccgatactattactcacgaacgtgtttgtcgtggtcgccaaggaattaacgggaatcaacatcacgacgtaaatactacgtacgatattcgccaccgccaactcccgttgccccaaatgctccacagcgataaagaatataaaccaagtagcgatagacaagaaatattgcagcatcgtgaacacggaaatatccagcacccgtttcaacaagccaaaatcgaaagaacgaatctggttaagcgcatatttacgtatatctacggtaagtctcgtgtaaaccacgaaaaagagaatcgataccgcctcggctatgacggaagcgatagccgccccttgaatacccatctttgggaatccggcatgtccgaaaatcaaaagataatccagtaagacattcgtcattgccatcaagacagcgttcaatgtcaacacctttgtacgggtaataccaataaaaagagcccggaacatcacgttcacgaaagagaagaagaagccaaacacacgccaatccaaaaattcctccgtggcattcaagatagcgtccgaagaaatcaatacacgcatcacgtctcccgcgaaaaaacgagaaaacaagaacaatatagcagccagcgacaataggaagaaaacgccttgtatcatgacaggccctatctggtcataacgtccctctccgtttctacggccaatcacgatttgagatcccgtactaaaaccgaaggcgatcgtaaaagcgcagatataataaagtcctcccatagcggaagcccccaactcgacttcaccaaccctacctagaaaagccgtatcagtcacgtttatcacgttttgcgccaacaagctcaaaaagatcgggtagctaacattccatatattcctgttcgtgtacataactcgcttattacttaaatttatgaagataaaaaaagcccgccgcatcccgacgagcttttcttatgattagagatctctacaaagtctagtgtctactatatcaacttatttgtcgccgtatcgggaaataccacggaaggcttgaatgttttcgcctcctcgaaatccatcatggcatacgacataacgataataatatctccgggttgagccttacgggcagccgctccgttcaagcaaaccactcccgagccacgttcgcccttgataatatacgtctcaaaacgttctccgttattattattcacgatcgagaccttctcgttcgcgatcaaattagcggcgtccaacaaatcctcgtcgatagtgatgctaccgatatagtttaagttagcttccgttaccgttacccggtgaatttttgactttactacctctataaacatgtatgacttataattagtatttgatattgtcgatcaaacgtacctctccgcaatataccgtgatgcaacctaccggataatcggtatccgaccagttcttgatagactctaacgtattgccatctacgatctcgtagtactcaacttccatgactggatcgctattaatcgtattgacaacatagtcaatcacttcttgtacgctttttccgggcacaaaggtagtactttcttttaacgtacgagcaattaacggagctttttgacgttgttccggtgtcaaacgggtattccggctactcaaggccaagccatcgccctcacgaacgatcggacaagcattgatcgttacagggatattcaattgtttcaccatcgcccggatcacagcgatctgctggaaatccttttccccgaaataagcgttatccggctctacgatatagaacaacttacttactacctgcgctacaccgttaaaatgccccggacgcttagcgccttccattacctcagataccgttcccaaatcaaatgtacgggtatctggctccggatacatctcttctacagagggagcgaatacatagtcacagccggcagattctaataacacacaatcagcctccaacgtacggggatacgtttccaagtcgtgtttgtcattaaattgggttggatttacaaaaacactgactacacatacatcattgtttttcacgcaatgttgtactaagctaagatgtccattatgcagtgctcccatggtaggaacaaagccaattttcttattatcctgctttgcctcagcaagataagccttcaaatctttaatactatttactattttcatcagatagatgcttaattgacggtgcaaagcaactaaataattaccgtaaataaaagatttttcgtatctttgtagcgtctttataaaactagtttacagaatggatgcaaaaaaaatcttgtttatagcccaagaaatcactccctaccttcccgaatccgagattgcgacaatatgtagaaatttgccgcaaggaattcaggagcgtggtcgcgaaatcaggacattcatgccaaaattcggaaatatcaacgagcgccgcaatcagttgcacgaggttatccgtctgtctggtatgaatcttattattgacgacacggaccatcctctgatcattaaggtagcatccattcaatcggcccggatgcaggtttactttattgacaacgaggatttcttccaacggaaatccacggtcagcgatgagaatggaaatgagtatgaagataatgacgatcgttcgatcttctatgtacgcggagtattggaaaccgtaaaaaaattgcgttggattcctgatgtaatccattgccatggctggatgtcagcgttaacagctctttacatcaagagaatgtatgccgatgacccgtgcctgcgtaatgcgaaaatcgtttattcgatctacaacgatgacttcaagaacccgctaaacaaagatttcgcgacaaaactgaaggcggacggagccaaagaagctgacttgaagttaatcaaggcagatacaagttttgtgggcctaaccaaattagcgattgatttcgctgatggtgtaatccaaggtagcgagacgatcaatcaagaagtccttgattatatctctgccaagaaagatactcctttccttccctatcagtcaccggaaacttatatggacgagttcaataagttctacgacgtggtattggattctaacacgaaataataaatgtagtaatgaaaatcaagcttttaatacttggacttggccttggtgctagcattttggccgggtgtaatgatgattttagttcgataggaacaagtattcagccaggcgacgatacaattgcggtatatatggacacgttccagatacaagccactacggtgcaattagattctatttacgcaaggtctactagcgcccagttgggtgaactctacgatccgctgtatggtaaccttgtatcggattatatgtgccaattctattgtccgagtgattttcaatttaagcatacaccttatgagggaaaaattgattcggtggaattcaatatatattataatggttccaataaaaacggtgtatgggtaggagactccttggcgcctatgcgtgcggagatctttaaaattacaagtccgttacaaaagaatttttatacaaatattgaccctaagcaatattgcaatatgcaagagtcaatgggtgctcaagcttatacagcttataacacaagtatatccgactcccttagaaactctgatggttacagccctcatgtaagcattaaaatgcctactgagttcggacaaaaattttatgatgaaacgattaataatccgggtacattcaagaatcaagaaactttcaatgagtttttcccggggctttatgtaacaactaccttcggtagtggtaatatattgtccgtggctagctctgtccttaagatatattataattatgcggttaaaagcacagcaggaaaagactctttaataaccacgtgggaagctttctccgtcactaaagaggtcattcagctaagtcgtttcaaaaatacggatatgagtcaattgctacaaccgaacgacagctatgcattttttaagactcctgccggcgtttgtacacgcatcgttcttccgacacaggaaattactccgatcatggaaaaacgtatcgtgaataatttaccactagagttaaaagcgatgccgcaagaagattggcaatatgcgctggctcctcctccttatttattgatcttgccggaggattctgtaaagagtttctttgagggtagtcaaattgacaataatgtaacctcgtttctatccaaggcttacgatgcgactactcgtacgtactcattcccgaatcttgccaatttattaaaatatcagatggagaataatccggacaaagatttgagtttacttcttatccctgttcaacggacaacgaccacaggtaacagttacggtcaaagtacagttgttacaacagccatcacgaattatctagctccctcaggtgtaaagatacgaaaggatgaagaggtgatgaaaattggtattacatcatgtaaatatgtcagatagcaaagaatctatataataaaaaaagcgagatgtttttcatctcgctttttttatatccgtatctctaaggcaaaaaataacgggtccctaaaaggacccgtcactctccaaaaatagtctagtcaaatcaattaacgacttatttcttcgccgccttcttttttaatttatctaattctttctgtagactctcgatttcctctccttgattcttaatcgtagaaagcaatgaattcaattcctcattctctatattctccgggaattccgcatttacacgaacaatgaaatcggaaagaacattcatatagttattaaatgcatcatacggattatcgtaagggctaaagccaccttgtcccatatgctttgtactcatataatagaaatggtcactgctctgcagatagtaccagtcctgacggatacgacgagtctgagacaaacgaacacgttcaccgatctcattaatcttacggaacgcttcctgctgcaatacatttcctaaccaagaactacaatctctctcctcatctacccaagagatcggataaggaacggagatagagtctaccggcttgatcaatgtaaatacttccgatggagtagagaagctaatccccttatccgcagcaaaacgaggcaaagccttgaagaactcaaaaataccggttgaagctggatgcaaagatcccagcacctcataattcataaacaaattaatgatttgctctgaatccggagtagcagcgatccatgacatatacttatcggctgtcaaaggatactcattccaactataatcactgaaacggttcgataaatcctcgctgaaacggtcattcttcaataataaactcaacttcggagctacgcaagaagaatacatatagttcggactcttccaacctaagatatgcttagcaccctccgtcaacatccccttatagcccatctcagaaaccatagcggaaatatcatccgagtaaatcaactccgtattacggaacactttcggtttaaccccgaataaagtcttgatcttatcttcttgtttctttacttgatgcttgaactcctccggatctcccaaggaagaaagagaatgagcataagtctcagacaagaattccacattccccgtagccgccaattccttaaagctatcgatcacttccggagtataaatctccatctgctccaacgctacgccggaaatagagaacgctaccttaaacttaccaccactggtcttaatcatctccaaaatagtccggttagccggcaagtaacattgttcagctatacgatggataatctcctcattctggaaatcatcgtaatagtaatggtcgttacctatatcgaagaagcgatatctttttaaacggaacggctgatgtatttgaaaataaaagcagatcgttttcataatattgtttgttttatttttgtcttgtcgttaatttatttgttacctatcacattgtcgtaaatacgacgaaccttttgtccggcatattcccatttgatattatccacctctttcttaccttccactttcaagaactcatgcatggcaggataagtaataatagaatacatggcatccgctaacgcctcaatatcccaataatccaccttaatcgcataatccaagatctcggcgcaaccggattgtttagaaatgatagagggtacaccacattgcatggcttccaacggagagataccaaaaggctcagaaaccgaaggcatcacatatacgtcactggctttcaacacctcatagacctgcttgcccttcataaatccggtaaagtggaaacgatctgaaatattacgtgctgcggccaaacgaatcatttgatccatcatatcaccactaccagccatcacgaaacgtgcataaggagccttagccaaaacctttgcggcagcctcaacgaaatattccggccctttctgcatcgtgatacgacctaagaatgtaataaccttatcctttacaccctttttatctgggatcgctaaaatctcaggacttaaaggctctacggcgttatgtacggtcgttaccttagcgggatcttgatgatatttctcgatcaccgtctgacgagtcaaattactcaccgttatgatatgatctgcattgtccataccattcttctcaatcgcatagacatccggattcacattaccacggctacgatcataatccgtagcatgaacatggattaccaaaggcttaccactcacatttttagcgtgaatacccgccggataagtcaaccagtcgtgcgcatggatgatatcatactcttccgtacgagcgattactcccgcaacgatcgaatagttattgatctcttccagaagattatccggataacgtccggaaaactcaaggcaccctaaatcagtcacatgacgataactgaaatccgcataaatatgatccctgtacttataatactggtcagcgttcattcccgctttggaaacccgttgctgcacatattcacggtcaacatccttccaaacaatcggaacttggttgacacccactatctttagaaagctctggtcttcatcgccccagggcttcggtatacaaaaagtaatatccatatcgggctgcattgccatgcctcgtgtcaaaccgaaactggccgttcctaaaccgcccaagatatgaggaggaaattcccatccaaacattaatgctttcataatggtacttagttttattcggcgttatacttcttcaacaaatccacaacacggaggatagccgcaacattcatcgcaaaagagacagctccacgtccggtaaacggtgggttaccatcaaacaattccgggatcgtcccgatacagtgtaatgacatctcctcctccaagcttatcaacatacgttcagcaaaagcaacgccactctttccgaatacacgcaaataagcttccaaataggcgcctaacaaccacggccaagcagtaccttggtgataagccaaatctcgttcatattgcggccccacataatacgggcgatatccttcgctcttcggactcaaggaacgcaagcccttcggggtaagcaactctttcgtcacgatatccactacggcacgtttctgcatcctcgtcaatggggaataaggcaatgccacagcgaaaatcatattaggccgtacgctccaatctaccgtagaaccattcacggaatcgaacaaataattatacccgttcacaaaggtttccgggaacgatttatccatcgacttgataatcggatcaataccctcgacaggtactccccccatcaattctgtatagaaacaaagagcattataccaaagagcgttaaattccactatataaccagaacgagttacaacaggttttccgtttacggtagaattcatccaagtaatcgccttatcttttccattagcgaaaagtaaaccattctccatcaatttcatatcgggatgtttctggtcccgtatataatcgataacttctttcacgaaatcgccatatagctcacgtgccttttcaacgccctcatgcttagcatactgttggatcgcccagatcgcccataaaaagacatccggatgctcgatctcacgaatcaccgcatcgaaacgcccattctccatatacgcccgcatcgccggcatcgccgtatgcatgatcttctcaaaacgaaccggatcatcgatagacaacgtactacccggaagagctacgaacaaatctctcgcacgtactttaaaccatggatagcccgctaatagataagcgtcgtcttccttgggacgaaaataaaattgctgagcggaattcttcaagcaattgaagaagctagtacgaggcgtacgagctacgacctcattctcatacagtgccttcaagcgggtagttgccactgcactatcgccagcgctgaaaataatagtctcaccttttttgatagggacctcgaaatatccgggaacatacaaatcctcctgataaggatatcccctctcttgttctttcggatactcgatgccattgtaccaatacggctcatacacaaatttaactttcttgttaaattgcatatacagttccggataaccgggatacatacatgtcttgattccgtttgtgacttcctcgtaagattggttcacgttaccattggcttgcgttaagttcttcacgctacggaaagcgaggaaaggacggaaacgtaaggtcgtagcggaatgagcatcttccaacgtatacttaatcatgatacgattctcgtacatggaaaacactttctctttcgagaagatcacacctcctacacggtaaagcgtacgaggtactgtctctgagctatactcgcggatgtacttatgtcccttgggactgaaattatcgcctgcatatttatgcaacccaagattaaattcggcaccatgttgaattaccgtctcatcaaaagaagacagtaacacatggttgtcatcatcaatcgcaggcacaggcataacgagtagtccgtggtatttcctggtattacaatcaacaacagtagtgcagtgataggctcccaaacggttggttcgaagcacctcacgagtcagcgactcttccaggtttatcattactgttttgtcaaatttaagataactcatatgtgtatttgggttttaagttactttctttaatatcaaaatgaaattattttcgtttctgagaatcaaaagtattatttaataactaaaaaaacaaactgtcttttatatttatttagaaaaaaaggcatccttcttctacgataaacttatagatcaaggctttaaaaagaaaggtgctctaaaggagtgttttcaaacatataaatttttgttaaatcaatcctattatcatattcatcaaagctcaaaatcaaggtacagccccccgaaaacaagcctcggtttagtcataggaaatgttctatttttcattttaaatcaatctgaatataaaaacagatgcctataatgttcctgtgattaaaatgcctacctttgcggaaattttcaaacaatttttaatatgaggaagttattatataatgtagtaattttattaagcgcaattcaaatgacacacgcagcaaataaccctttcttcgggaagtttaaaacaccgttcgagacccctcctttcgataagatcaagatcgagcattatgagcccgctttcgacgaaggaatcaagcaaatggaaaaagaggtgcaagagatcgccaataacccgcaaccggctactttcgagaatacggtagtagctctggaacgtagcggcaaattattagaaacagtctcttctgttttttttaatgtattaggggcagaggctaacgacgaaatgatggaaatctcgcaacgtgtctccccgaagttatcccagacatccaataacatcttcttaaatgagaagctacttgctcgggtcaaatcaatctatgataaaaaagaacaattgaacctttctaccgaggatgctaaattgctggaagacctttacgagtcgtttaaagcgaatggggctacgttaaataaagatgacaaggaaaaataccgcaagctaagtatggacctaagcatgttaaccttgcagttcgatcaaaacgccttgaaagataaaaaccggttcgaattactaataacggacgagaacgaactatccggcttacccgaaagtgctcgtgacgcagcggccatgttagccaaaagtaaagataaaaatggatggttattcaatctctcggctccgagttacattccatttatgcgttattccgacaagcgtgatttgcgagaaaaaatgtatcgtgaatacatgagcgtaggaaataaaggggatgagttcgacaataaggacattatcaaaaagatcgttaatatccgcctagagatcgcccagttgatgggattcaagaattacgccgaatatgcgctggaacacacaatggctaaaaactcagcgaacgtatacaaattattgaatcagttactcgaagcttataaaccgatagcgatcaacgaatacaatgcggtagaaggatttgcgttaggtacagagaaagagaatatcaccgttatgccttgggactggagttattattccgagaagttacgggatatccgcttcaaggtaaacgacgagatgactcgcccttatttcgagttaagcaacgtaaagaaaggcgtattcggattagctacccagctctacggtatcacctttaaggaaaacaagaaaatcccggtttatcatccggaagtagacgcttacgaggtatacgatgccgatggtaagttccttgctatcctttatacggacttcttccctcgtgacggaaaacaatccggcgcttggatgaacaatatcaaggctcaatacaaagataaagacggaaaagatagccgtcctcagatcgttatcgtgatgaactttacccgtccgacagacacgaagccctctttgttaagtttcgacgaggtgaacacactcttgcatgagttcgggcactccttgcacggcatgctagcgcaaggaacatattccagcctttcgggaaccagcgtttatcgtgatttcgtagaattaccttcccagatcatggagaactggttgactgaaaaagagttcttagatcagatcgccgttcattaccagaccggagagaaaatcccgcaagagatgatacaaagcttggtaaacgcctcaaacttcaacgctggctacctttgctgccgccaattaagctttggcttgctggatatggcatggcatacgttggagcaacctttcgacggtgacgtagcggcattcgagaaaaaagcttgggctccgaccgtaatcatgccggaagtaccggaagccttgatgggcacaagcttcggacatatcttctccggaggatacgcggctggctattacggatataaatgggccgaggtattagacgccgacgctttctccgttttcaaatcgaaaggaatcttcaacaaggaggtcgcgaaatctttccgtgacaatatcttatccaaaggtggaacagaagatcctgccgtgttatacaagcgtttccgtggacaagagcctacgatagacgccttattaatccgtaatggtattaagaagtaataatttaccgggcgataagcccggtaaatctaaataatcactacctttgtgtctggattaaaagacaaaagagtaaacaaatgtgcgagaaaacagaaaaacagcacgaattagataaacgttacctgcgaatggccgctatctgggccgagaattcgtactgtaaacgacgccaagtgggcgcattattagtaaaagataaaatgatcatatccgacggatacaatggaacacccgccggttttgaaaatgtttgcgaagacgagaataatgtcaccaagccttatgttctacatgcggaggctaacgccatcacaaaagtggcagcctcatcgaacagcagtaaaggagcgaccatttatgttacctcctccccttgcattgaatgcgcgaaattaatcatacaatccgggatcaagcgagtggtctattccgagaattatcgaatagcggacggctgcgaattattgaagcgtgccggtatcatagtagattatatagatttgaacgaataaataaaacgtttttatggataaaaacaaaagactgaccgtatggctcccggttatcatcgcagctagtatcgctttaggtatctttattgggaaccattatttatctatcagtcaaggaaaaaaacggtcctactccagcggcaacaagataaatgccatcttggacattatcgacgagcaatatgttgacacggttagcatgtctaagttggtagagagtacgatcccgaaaatattcagtgaattagaccctcactccgtatatatccccgcggaagacgcttccgtggtgaatgaggagctggaaggttctttcagtggtattggcgtatcatttaatatgcaaaccgatacgatcctagtgattagcgtaattagcggcggtcccgcagagaaagcaggtttactgcccttcgaccggatcatctcgatcaatgattctattttttccggaaagaaaaagaaccaaggagagatcatgaagacacttcggggcgcaaagaacagtacggtgaaactaggcgtacagcgagggaattctcctgagttgctctattttgacgtaacccgtggagatgtcccagttaattcggtcgatgtttcttatgaggcggctaaaggtataggttacatcaaggttagcaaatttgcccggaatacttataatgagttcatcacggcgatcgccaagttaaaacaagcgggctgtacctctttcgtgatcgacttacggggtaataccggcggatatatggatgccgctatcaatatgattaacgagtttatgccggaaggacgcttgatcgtctacacggaaggtaagtcgttcccccgttccgacgtatacgcgaacggaaccggaacttgtaaagacgccccgatcgtagtattgaccgatgagatctcggcttccgccagtgagatattctccggagcgatccaagataacgaccgtggtacgattatcggacgaagaacgtatggcaaaggtctggtacaaactcaaatgtcattgagcgacggttcagagatgcgattgaccatcgcccgttattacacgccgtccggtcgctgcatccagaagaaatatgagatgggtaatacggacgcttacgaccaagatatctataaccgatatatgcacggcgagtttgactcggccgatagcatcaagatggatgattccttaaaataccagaccgtaggcggacgtaccgtatacggcgggggcggtatcatgccagatatctttatccctcgtgatacgagtggcgttacctcttactactcaaatgtggtaaatagcggcgtgctttacctgtatgcgctcgagtactcagaccgccatcgggagaaactaggctcattcaagacttgggaggaattatataattacttgcagcaacaaccgctcctttccgacttcgtgaacttcgccgctaccaagggcatcaagagacgtcctacattaattaatatatccggcaagttaatcgagaaccaattgcaagcgtatatcgtaaggaatttcttcgacgaggcgggcttctaccccattttcctaaaagatgacgttaccttattacgcgcgatcaagatcttgcaagagggaaaatctgtgccgaacgcggaactattaaaacaatcagcgaatggagacttacacagccaagcaggccctacgaaaagatatggcctctcgaaagaaagaatattcgaggattaccttgtgcgagctatcggataagatcatggaccgcttggaacagacggaactgttccaagcggcttcttgtatcgccctttatcacgctatagcgggagaagtgcagaccgccggctttatcgagaaatggtaccaaaagaaaaagcttctgttgcccttgatcgttggtgatgatttgagattgcttctttacgaaggaccggaatccttaaaacccggacctttcgggatattagagcctaaggtggacggcatagaagttccaaagaatgagatcgacttgattatcgtgcccggagtcgcctttgataaagacaagaaccgcatgggacgaggaaggggattctacgaccgccttctttccacgctcaacgctcccaaggttggcatatgcttcgggttccagatgataccgcaagtcccggtagagccactcgacaagaaaatggattacgtaataacagaagacaccatctattgatctctccgcagaatatatacttactggggctgggcagtatatgttacttgacccagtaagtaatattgcgaatggtaaagccacactcaatgaaaaacgatattggtaatgaccgaggcacccgcgtaatcattcaagcttttcaccaaccgttcccggcaaagcgtcaactcgctacgaagtacggaggaagtcaatgagacatgaagcaccttatcacgtacatatatattacgtgtgtactgcatgatcgtaggccctaaaacttctccccacgcacgttggacccggatctccatcattttctcgtacaactcggtattatcctcgaaaaagtcacgaagcacctcacccaatgtctgtgtatttcttctctgcatccttattcctccataggttgtacctcgccacgttccacacggaagagggcatagtcatgattcatagccaataagatctcatccagatacttccggttcgtatccgtaataaaaatctgcccgaagccattctcgctgaccagtttgatgatctgctccacacggctagcgtccagcttatcgaaaatatcatccaacagcaagataggtgtagtccgtccccgtttatttaggaaagcgaactgagcgagtttcaaggcgatcagatacgtcttattctgtccttgcgaaccaacccggcgaatcaggtacccgcccaacgtcatttccagctcatccttatggataccggaagaggtatagcccaatatacgatcccgttcccggctcatcgccaatttaccggcaagctccgtttcctccaattgcgagatataatgtagccctacctcctcggcagagccgcagatcgtctggtagtactcattaaagatcggggtaaaatcctccaccagttttttccgcttctcgtaaacgatttggccgtacatacccagctgcatctccaatacctcataaagagaggcatccatgctctgatctttcagcaacgtattccgttggagcaacgctttattatattggataagcgcatgcagataaggcttgtcctgctgcgagatgattaagtccaaaaaacggcgtcgctcatcgctccccccccggatcaagtcggcatcagccggagagaccatgaccaacggtaataggccgatatgctcggacagcttgtcgtactccttcttattccgtttgaactgtttgcgttgcctacgccgcatggcacagaaaatctcctcctcacgtccctcataatcatagttaccctgcaccacgcaaagatcttgatcactgtttattatctggctatcaggcgtattgacatgactcttgcaaaacgagagataatgaatggcatccaatagattcgtcttccccatcccgttattgccgaaaaagcaattcatcttgggcgagaaaataacctcggactgaagtatatttttgtaattgagaacagaaagcttctttagtatcatctaaaccgtattaatcgtacaaaattaaaaaatatacttctaagtatagattatatcagcaaaaaaaactacttttgcgctttgaatcgccaaccgtatggtatggcttaaaatcagcgataaaattaataaataactataacacattatggctactaaagaaaaggacaccaacaaggagttagaagtagaagagattgtctccaaatcggagcaattcattgaaaacaattcaaagaagattatttacggtataatagctgtcgcactcgttgttggagctgttttgggaatcaagcatggttatttagttcctcaggagaaaaaagctgccgccgccatgttcaagggtgagcaatacttcgccagagattctttcgccttggctttaaacggcaatggagctgactatgaaggtttcgaggctatcatcgaccaatatggaagcacggacgccggaaacttggcgaaagcttacgcaggtatctgctactacaagatgggcgatacgcagaaagcgatcgatttattgaaatctttcagcggaaaggaccaaatggtatctccggcggttacaggcttgatcggtgattgctacgtgaacatgggtaatacgaaagaaggcatcagctatttcgagaaagccgctaaggaggccgacaatgaggtaatcagcccgatttacttgaagaaggccggtatcgcttacgagaacttgaaagagtacgacaaggctgtaaaggcttacacgactatcaaggacaagtattacacttccatggaggcatccgatatcgataagtatatcacccgtgcttcggcaggaaaataaataaacagtatattatatagtataacagaggatgtctcggtcaaacaaggcatcctcttcttttaaagagacaagtatggctacagcttatcagaatttatccgagtacgatttcaacagcgtacccgatgcttcagagatgaacatcggcatcgtagttgcggaatggaacaagaacattaccgagaagttattggaaggtgcttgcaacacgcttgaaaagcacggggtgaaaccggaaaacatcgtagttaaacgagttccgggaagttttgaactgacttttggagccaaaagattggccgagactaaagaattagacgcagtgatcgttctgggatgcgtcgtaagaggcgacacgccacattttgattacgtttgttccggcgttactcaaggtattacagaattgaatttaatgtacgatatccctttcattttcggcctgttaactaccgacaccatgcagcaatccgaggatcgtgcgggaggtagatatggcaataaaggggacgaggcagcggttaccgcaataaaaatggtaaatttttctgcctaaacgcttgcaggtttcaaaataaatcgtacctttgcactgcaattaagaacaagggggcagttaccagagtggccaaatggggctgactgtaactcagctggctttcgccttcggtggttcgaatccatcactgcccaccttaattgatcggttcactatgtgaaccaattctttcgaaaaccgaaagaatacatattgcggaagtagctcagttgatagagcattagccttccaagctgagggtcgcgggtttgagccccgtcttccgctctaggaaaagaggaaaatcgaaaggttttcctctttttttatatcctcgtattactatatatccgggataatgtctactttagcccccaatacaacaaataacaaaaagagagatgaagatggtgaaagggatatacgtgttgctgacaatgttcttattgataggatgcgctacggtaatgaatccttataaaatggacaaccggatgcataagatagagctagggatgaccaagcaaaaggttatatcgatactaggaaaggattttgagtcggctggcgcacggataacccccgacggcccgatagagagtatcagttataagacggtaaccatgacgatagccgactactctgaaggctactacatcctaagcttcaagaatgggatactagtggagtggttcaaggaaaagacaccgatcaataacaatacagcgaactaaggtctccttttaggccactaaaaacaaataaggcagatgcctctgggcatctgccttcattcttttacgattataaactttcttcgatacatgaatccggttatgactgaccggcctgccgtggttttctaactcggcctcacgactgcctttccggttagcctttatgtactcgactaacggatcttgcttttttctctttgtcttcatagctttattgcttttatatcgctttcacgagcgcaaagatacgaaaagaattcatttcacctcactatcgtcccaagggtattttcttttcggatttcgagggaaccagcctttctgcacacgctcctcctgctcgaaaatctccttgatcgtccagaacgatgaaaaggcgaatacgccgcaaatagcggacacaaacacgctgtctataaacagggaggctatcactcctaaaatccctaagacaaggaatatccaccagcatttcgtcccccaataatactcggccttcacgactaccggatgaaacagaccgataatcaaaaatgtaacgataccgatcaacaacccatcaaaatttatcatatccatatctgagtatttatacttattactattatatgtaacaaatatacgaacaatattccacttaactgatcatttctttctatgaagagatagaagcccctattcgcaataatcgtctcacaaagatgaaacgatcttttcatatacgtgatacgatcttttcacccttgtgatacgatcttttcacataggtgaaaagatcaagacctaaagaagcttacacttaaagtagcacaaaaaaaagtcacatccattgttagtagacatgacttctatattgttttcaaataagattcttatctgttgctttcctccgcaggtgtagtagtagcgggagtttcctctgccggaactgccggttgttgagccgtaccaaagtccggagcgatcgtattcggatcgatagagatagcgtcgtttacttgttgcttgatctcagattgagcggcatgctccgctctggggataaatgcggtaatcaagatactcaatacgattacggtacccgccaaactccaagtagctttctccaaaaagtctgtggtcttacgtacacccatgatttggttagaagaagagaatcctgaagccaaacctccaccttttgagttctggatcaacacgatcaagattaatagtatagaggcaatcaggattaagatagaaataaatacgtacatcttagttttattttttagtgttaataatcaacttttccaaaaatctgatttggtctgcaaagtaaacatttttttctggatatttcaagcttaagtttttaataatttgcaaagccttatcatatcgcttctgttttatataaatccgggctaaagtttccgtaaggcacgagtcttccagcgatttggactgctcatcatccaaatctttcaccgactctggagtctccgcacggctgttttcctctcggatttccagcccgctacccggcatacgctgttggtcatttttaatgaacgaatcgatcaagtcgtgatgtcgaagcctattctccgcatcctctccagatggcttctcttcttcctctttcgataatgaccaaaacatataatctgacgataccgatggctggaacaggaacggggcttctttcttaggctccggttcctcgttacggttagagaggaatgcgtctatcaaggagaaagtatcctcttttcgcatatccggctcatgctccacacgggagttcaagccatatttatctccctctatcagttggaacagcattttccggtccggcaagaatatcgccatcttctccagctccgaggtaaaactcatatcatttaatacggccagattctttagatacaacatccgtgccacttgaaaatacgggtaatcctccacgattcgtcgcaactcaagaagagtcccctcggtcaattccgaaggctcctccatcaaacgatataaatcctccgccctcattctaccaattggcaaccgtagcgttatagatttggtctactatttcctctatgatctcctcgcataatgttccctctacctgctgcggcatcaagttactgtcgaactcgcggtaagcggagaacgactgctcgaaatcctcatccgggttaacccggttggagtaacgaacccgcaccgtgatcgtcaacctcgtctgcgaggcgatagcatcctccttcacggccattggagcgaaatcgtaaccagtgatctcaccctccaactcaaggtcgccattgctcggaaccagttgcagacgagtctgacggatgtaaatatccttcaaatcctccgtaaactgcggcgcaagggtcggattcacgtagggagcttggttcgtgaagtcacgaatcgtaatggtcttcaccttcgtataatcgatagaggctccattaaacttataggaaatagagcaagccgtagccaataccgtcaaaaatgagagtataagccaattggctgccgacaaacgtatgttgacaatcttctttagcatattttattccaaattgtattccttgatttttcgatataacgtacgctccgatatcttcaagtcggccgccgcgttcttccgtcgcccgttatgcttctccagagccttacggatcatctccttctccacctcttccaaggataaagtctcctcttccacatcctcggcatcttggatcgtcgggtgcatggcatgaaccgccgccggatggatcggatgcgcataaggggtatcgtccgccaccgttggcatcgggatattccctcccatgatatcatgcactaatttctttagctcgttcacgtcctttttcatatcgaacaagacttgataaaggatctcccgctcgctgttaaatatcttttgatccggatcttgcttcaccaataccggatatttctcaacgttcacgttcggcagataaaggcgcaggacatccgccgttatatcccgtgtctcctcgattacggagatacgttccgtgatatttttcaactcacgcacgttacccggccaacggtaagaaaccaataattgacgggcctcatcatccaagcggatcggcggcatccggtatttctcggcgcaatcactggcgaacttacgaaataataagacgatatcttccggacgctcccgcaagggaggcacttggataggcaccgtattcaaacgatagtacaaatcctcacggaatttaccttccgaaaccgcctgcactaaattcacgttcgtagcggcaacgatacgcacgttcgtcttctgtaccttggaggaaccgaccttgataaactcacccgtctccaacacacgaagcaagcgtgcttgcgtaggagttggcagctctcctacctcatccaagaagatcgttccaccgtccgctacctcgaaataccctttacggtcggctaacgccccggtaaaagaacctttctcgtgcccgaaaagctccgagtctatcgtcccttccggaatggcgccacagtttacggctatatattgtccatgcttacgctgactgttctgatgaataatttgagggaaagtctcctttccgacaccactctctcctgtaataagaacagataagtcggttggcgctacctggagcgcaacatcgatcgcacgatttaatccggggttattaccaataatcccaaaacgctgttttatctgttgtacatcaaccttcatcactctttcacttttaaaatctgtaattatttcagttactctgccaaaattacaaatcttaattcaaactaccactattgataacagattctatcggtcgtttcttattttttagcaccatatgtacgtttatacaagaactcggcaagatccttgtcttccgggatggcggcgatctcttccggcgagataggctcaccgatatatacatccgctttctttccacgcttattgaaagcctctgtaggaatacgcaaggtacgtatttgccagctgatattccctagccaatagaaaaaatgggtattttggaaatcaaaataaacagggtataccggtgctttcgccttacgaactaagcggatcacgctatgcgcccacgataaatcccgtacctgtttctcttttttattataaaatgagatcgctccagcagggaagaaacccatcggatgaccttctttcaagcgttgcagggatagtcgaacgccattgacattcgccggattcgcccctcgcttgtgggaatcgggcaccacggatatgaaattatcctccatcgccccgatcttggtcaagatgccattcaccatcaccttaaagtccggacggcgggaagcgaaaatatcaatcagcatgattccatccaacgacccgatcggatggttggaaacggtaacaaaagccccttccggcagatgatctaaaatctccttattatgaacctcatagctgagatcgataatggggtcatgcaataaagcggaagtaaactcagcgccccgtaaatgacaattccgggcatgtaccttattaaccagatccacacgtaagcactttatcagcaacttacctaaccatgtccccactcgccccttgaagaacggggccatctcttgcaaatcgtaaatgtcaacaacactcttcttcatactttatcctaaaaacgaggcacacatcttctcatgtttcctcatcactatcgctagtacgatgttcaacacgatgatctcgtataggtaataagcccagacctgtcccgttagtacgatcacaaacataaccatcgtccggccattaaaggtcaacaagtctatgtaacgcattaaatgacgactctgtttacgaaagtccacacggatattctccggaatattatccccatacttcgcatgcaaattttgtaacatactctgtaaggtaggcgtagccttcacttgcaacatcgtataccaacgatataagaagtagaaaaacttgttaatgccatacttcatctccttatgtttcgcctccacctgctccaaagactgaaactccgagcctttatccttactgataaaataaaggtgaagcgtcttataataatccgtgatattcgcttggactaaatgagacaaaccggataagaccgccaaggcaaagaaccaatccgtaccgtaatcatgagacaaacgaagagcgaatccgatatagatcgaagcgaaccagatatccccggcgaatccgtccaagatacgcccgatagcggacttgattcctgtaagacgtgccagctgcccatccacgcagtcgaggatattggcaaataccaacaataatataccgcagatattatatgtcaaattatcgtgataaaacataaatccgaccgccgcacccacgaagatcgagataaccgtaatcatattcggggtaatccccgtgcctcgcaacatacgagcaatacgaaatcctatcggacgataaaaaattcggtctatcttattttctgtttctatcgactttaacgatgcttcgtattccttatccaactcgctcatttgtttcttatttatacgagtaaccgccatccacaacgactacctcgccattaaaataactattctctatcaacattttataaacttccgccaattcatccgggtcgcagaaccgtcccaaagagaccttgttctctatattccgacggatctcggcaggctttgttttctgccattccgtatcgacaaaaccgggagccacggcattcacacgcagttcatagggaactaagaacttcaccatgtttttgaccagcgcatgaacagcacttttcgtcactccatatgccaaggataccgaatgaggctgtattcccatcaaggaacccgtaaacacgatacttccccccttattaatccgtccaacaatcttctgtaaaaggaagatcgggaaatggatattagcaaagaaaacccggtcccaatcctcgaatgaaagttcctcaaaaggatcccgacaggtcattcccgcattgaacacaaggccgtccaaacgtagcctattctcctccaagaaagaatcgataaccccgatcgtattccgatccgagatatcggcccgcagaatagaaacctgtatatcgaaacgacccaccaactcgctacgtacctcctcggcggtcgcttggtcggaagcataagtcagtataaggttatatccggcctttcctaaacaggacgctaccgcctttcctatcccttttgtcccaccggtaattaaaataaatttatccatgaaactgatcgttatttagcggcagatcctttcactgtttccggcttcgcctgacgttgggttgtcagattcgcctcataagaatcatgtatcgtttttttcagattcgaggaggaaacccccgttccgtaagggaaataaaatacctgaacgcctaaatccttcagatagtcgtactttccgaaccagtcatcacctaccacgaaagcgtcgatattcagcttcttcacgatttccgtatgatccaaggaatgttgtggaataacgatatcgggagtcttcaacgcctcgatgatctgcaaacgttcatggaacggaatgatcggcttcgctttataagaagagaccaactcatctgtactaaccccgacgatcaatatatccgccaaactacgggcgtaattgatcatcctaagatgattataatggaacatatcaaacgttccggatgtatatactatcgttttgtctttaaacataatcgtaattttcgttttaaaccgcaaacttacgcaaacttttcctatcttaaaagtttaaaaccaaaaagcgtcccacgtcccatacaaaaatgtcatgtcaataacatccattcgttattaacatgacattttatgtatttattgaaacttgtcaggaaagatctactataatccgtccgtatcgtcgtctttcgtcaaatccaatttctcattatctccccccctatcgaaatattgcttacgcaacgggttggcggtagcctcctgataacgtaaccggttccggaagatatccaacgccgcatataaggcttggcggaacgactcttctgaggccacgttctgcccggctatgtcataagctgttccatgtgccggagaagtccgtacgatcggcaatcctgccgtatagttcaccccgtcatccatcgccaacgtcttgaaaggagcgagcccttgatcatgatacatcgctaagacaccatcaaatttatcatacatctgcgaaccaaagaaaccgtcagccgcataagggccaaatgacattacgccttttttctccgcctcttgcattgccggtatgataatcgtctcctcttccgtacccagcaatccggcatcacccgcatgagggtttaaggaaagaaccgcgatgcgtggcttcacaataccgaagtcttgctttaacgactgattgaaaatacgcagcttattcacgatatcgcccacgttgagggaagacgcaacttgcgacaatggaatatgccccgtcaccaaagcgacacgaagatcatctttcatcaagatcatcaaggcttttttatccaagccaccgaagcatttctccaaatactcagtatgcccgggaaaatgaaaatcctcgttctggatattatgtttattgatcggggcggtaagcagtacatccactactccccgcttcatatccgtaaccgccgcttccaacgccttgaaagccgactcaccggcaaccggcgtagatttcgacaactccaccttggtctcgtcctccacgcagttaataatgttcacccggtttactcccgcatcctccgcatgtgaaataatattcatattgataggaggaagctccaatgccttccggtgataagcggctatcttggacgagccatagataatcggcgtgcaaagctccgccatgcgggtatcggaaaaggtctttaatatcacctcatagccgataccatttatatctccgtgggtgatccccactttaatcagtcgttcttccatatattttgtttgtttattactttttctcttttgggatatccaatgtctcagttaccggttcatcaaattcacccggcaaacgtaacgtaaataaggcagcttctattctacgcatgaaattacgcttgtctgtctccggagcatacacaaatccctcggctacaaccacacgatgattcttttcatccaagcgggtgtggcttacgaacgggcctcccatcatatcgccttgcattctccacaaaccgcgcatcacgccacaatatttaccatttaaggttattggcgtatactccactcccgcacgcgtttctgtttgcatataggaacccgggaacgaacccggcagattcgccttcaatacagaatctcgtttagcgaccagatattcctccgtaaacgtattcggatcagtataagggaaagtatatacgattaagtccatacggcctgtgttagcgttattggaagaccagaagaaatctgtcgtatccttatagtacgtgaagtttgccggagcgtttaacatcacgttcaggtcgcttttcaggttatccataaccaccatactatattccttttgtaattgctctatcgcacgattcatctccacctttacgaagaagttgaccaacgccttctcatgggtctttgaatactcgacgatcgactccgtattaggagctttcagcgaaacaaccacctgtcctctagcccagacattattctcgtagcctacagaaactttcgtataagcggtgggatctatcgtaaccactaatatattccttacataccgtaacagacctgtaaaatcctttggttgtacgtaggtaatcttcaaagaaggctcggcttgcggcagtccgggcaccgaagaggccaactcagactttatggcttctcccgcagggcctttccaatccttttgatccataaccacgacaacctcatatgcgaagcccgtagcttgagtcatcacagaacccgaattacatgctcccatcaaaacaagaagcagcaacataccgatgaataaagaacgtgttttcatacccgtgtgttttatattatacaaatgtaacattttttgcggtagaaagcattccacaagcggcgaaaatatcctcccctcgtgatgcccttatcgtacatacaactcctttggcgtttaagaaatcccggaacgcctccattttagcgatatcggaagtctctaaagacacattcggtatcgcatgaaaacggatcaagtttacccgacaaggtattccacctaataaacaactcaaagcttcggcatgtttcaagctatcgttcaaatttttaaaaacaatgtactcaaaagagacacgtcgttgatgcgaaaaatcatattgtttgattaaatcgatcacctccctcgctgggaatgccttttcaaccggcatcaaggaaagacgttccataggatagggcgagtgcagacttacggccagatgacattcgctctcctctaaaaagcgtttcaagcctttcgtcacaccgatggttgaaaccgtgatacgcttcgggctccacgcatatccatacggggccgtgagtatttccaaaaccttgaaaagctcgtctacgttatccagtggctcccccattcccatgaaaacgatattcgtcaatgaatcgttttccggcaaagactggatctggttcaatatctggttcgctgtcaggtttgccgtgaagccttgttttcccgtcatacaaaacaagcaattcattttgcatccgacttgagaagagacgcaaagagtcgcccgatcatccgtaggaatataaacagactcaacaaaacgccccggtccggcagcatatagatatttgatcgtaccgtctttcgacttttgatactcagatggcggataagccccgatctcgaatgaatcctctaataaagcacgtttggctaccgctatattcgtcatctccgaaatccgggttattttcttcttataaatccaatcggccatttgcttagccgcatatgcgggaagacccacctcagacgctacacctttcagttcctccaaggtcatccctaataattgtcttttgtcaaccattctatcgatattttcttattcgcgaaagtacgagaaatattccacaaaataaagatcccctgttttgccgtcaagatatatttattttgacggcaaaacaggggatcttttttatcttaagtataaatactctttattaatagaaacggatacggttgtcttccaccttagcgttgttgaccatagattggatagcttggaatcctacacgatacgcattcgaagcatccaacgcacggatttcctcagcctcgttgaactccttaccatctttatttcttgcgtatactttgaacacatatacaccgttgttacctttaaccggagcacttacttggtcaacttgagccatagaaaccatagcgttcaagttcggttcgataccgataccagcgatacggcgagtaccaaagttcacgaacttcacagagtctacagaagaacccatcgtttcagcatatgcctcaactgaagttaaattcttagcagccaattcctgagcgatcttatcgcctttcttctgggcagccaattcagctctcaaagccggagcgaccatatcaaccggacgatacccctcggaaatacttccttctacagcagccacgacaaatttatcactacactcgaagatctcagagatagaacctttatcgttctggaacgcccaacgaattaccggacgtgaattcttgatagaacctaacaactgatcatctgtagtaaccgttgcacctgaaatcaagttataaccggcttccttcgcattctcctccaatttagccatagagttgttcttagatacgaactgattcaactcattgtagatgttgctataggtcttagagctaggagatacagtcatgtcgatatctgcgatcttatatttttcaacatttcctgttttctctgttacttttacaaggtgagtaccatataaagatttcacaaccgctacctcattcaatggagttgagaagacagccttcttaaaatcatcattcacacctctcaaagcggtaacctctgtaaaccaacctagttcaccaccattctcggcagcttggtctgctgagtatttcttagctaattcagcgaaattagcgccacctttcaacgcccccatcaagctatcagccaaagctgttgtctcagcctcagatttaccggccaacatgatgtggctaacttttactgagtccggagcgaccgtcttatcgactagcttaaacattctgtatttgtcattctcgaatacaggaccataaacagcgccaacctcagaagtcgtagcgaattgtttcatctcaggatccaaagccttctccgtgaagaaagcgtcaacataaggaacctcagagttctcgtttactacatcagccactctttcagacgtagctagctcctctttcaagctctcgatctcggcctgtgccttatcataatcctctttactcggacggatatctacggcgatatatttaattaccttagattctttttgtttataaagctccttgcgttggttatacaatttctcgatctcgctcttgcttacctcaatcgttgaatccggaatcgtagcatatgattgcatagcgtaaatgatatccgaattctcggcattatcattataagcttccttagcgtccaatgaattcgcggaaatagccttactcaataatgtcgtatatttttgctccaaacgttgacgtttgatgttcttctcccagaacaaccagaagttcttagcttgaatcagctgtgcctgttgatctgccggatagctagcgatattatcggaatcgatttgtttcaagaaattcaacaaagcggccttatcaaaagcaccagtctgaggattcgtaaacatttgcatttgttggatcaacggagagatattctcaccttgaaccatatcaaacaattcttccggacttactcccatacctaatttagcagtagcctcgtccaacacgacctcttgtaccatcgcatcgaatacggactggcgaatctgtgtcatatattcctcgggcaggctggctgaaccggattgcatcttatacatctcggccatctcatcaacgcgaccttgataatcttgaatttttacaacctctccatcaatctcggcgatccgttcctgtgattgcctaaaataagtagaaccagagtttaaaaagtctccaatgataaaagcgaacaatgccaaacccaccacgagtaccagcagtcctgctttgcttctaattttttccagcgtagccatttatctttattattttttaaagtttattatttcacattttaagggcacaaagatatgaaaaaaaggaaattccacagcatataatccttttttttatcaaatccctactttcatacgtacaagttcgatcttcgtagccgttactttgattatcttaaacgaatatttatcgatctggacagtctcgttcaatttcgggaatttttgatagaagtgcaagataaaaccggcgatggtgacataatcatccgactccggaagatccaacccgaacatttcgttcaaggtatcaatctccatcctacccgacagcaaatactcattgtccgatacttttttagccacatgcgacttcatatcgtgctcgtcctcaatctctccgaaaatctcctccaccaaatcctcaagtgtcacgatacccgacgtaccgccaaactcatccacgacaacagccaagctcttcttctcttgcatcagcagtttcatcaatttattcgccgccatcgtctccggaacgatcgatacgctacggatatgctgggtccaatcctccggattcttgaaaagctcggaagaatggatatacccgataatatcgtcaatattctcgttatacaccaatatcttcgaaagtcctgtctcgataaacttagaacgcaattcctctatcgtagccgacgtatcacaggctacaatctccgtccggggcacgatacaatccctcaaacggacattcgagaagtctaaggcgttttggaaaatcttaacttccgtatccatatccgaattttgcggagcatcttccagactttgctgtataaaataatccaagtctaccttgcctaatgcctgaggtgaacttttcaagttcttcacgccccctaacttcaaaatcaaaaaagatagcagggatgagaacttggagaccggatacaggatgatatatatgataaataatggtatcgcaaatatattgagtgataaattaggattcaacttaaatatggtcttgggaataaactccccggcaaacaagatcaagatcgtagatatcacggattggataaaaacgatcaatgcctcattcgcaaccaccttggctataaacggctccaatacgattgccatctgaagaccataaacgaccaacgcaatattatttcctaccaacatggtagagataaacaaatttggattacgatagaaaatacccagtatcttactggatagactacgttccttcttatccagctcgaaacgaagcttattggaggagataaaagcgatctccatcccggaaaagaatgcggaaaatgcgagggaaattaaaatataagtcagcgtccccaccttaattactttttattgaatctatttgtgacacatctacccgggcactatccccctgagctgtccgtgtcgtatcggccggagcatcgctcaccgggaaaataccttgtgagttaaatatcttatactgagtcatatcttggttcgactcaaaacctatgcctgttatgatcttatcttcttgctcgatacgcataaacttatcagaataaaccttctcttgcttctggtcccagaacaattgggaagtctcaaaatgctccccttgcagactttccacctctacattaccgatcagctcccaaagcccttttttatcataataataggctgtatccgccttaatactcgcttctgtctggaataaggtatcgaacttctccacgtagatcccctcggggaaataccaatggggttccgccgccttcccataaatctgccactctttcgctttcaagcgatatctcgtgataccagaatcggagatcaaggatgacacatccgtagccttcatcgtataagtcttgtccgggtcaaactcaacatcaaccacctccttatgctccttactgcaagaggcagaaaacaaaagaagcataacaaccaccacgaaggtagttgttatgcccatattttccgttttacaatgaaaacgatttcctatcataattaccgaatcgttgtacgctctccgatccaaccaccgacagtgaaaggtttgcccttctccaaatccgggtgcatgaagatctcctccgtagaaggaaggtgagcacgataagatgatatcaaagtattagcctcttcagcaacactcggatctacctgtttcgctttctcaaatttatcgatagcggcattataagcagctcttgccaatactccatcattcgggaagacagatttagaagtagcggcatacatcttgccgatcaataaataagcattgccatagttaggatttacctccaaagctttctggcaatattgtctagcctttgaataagcattttgctcaaacagcaacaatgcgatcatataataatcatcagcttttgaagtcgcgtccgtttctaaattcgcagcctcatcaaagtatttaatagccgtatcataatcctttatcttaacggctttctttcctagcccaacagcagcctcggcactaggttcttgacgataagcatagtctgatgccaaaaagtaagcctcgatttcttggcaacctgttcttctcaacaaggatatagtctctttcaaataaggtaagttgtccttattctcctcgatcttagcagcatacaaattctgcaaagtctcgcaatcggcagcaccactattcgcaaaggcattatcaacaccactcttatatgcggtcaaggcattcacttctttttgattgtttgcagcctgcgcagcttttaactgagcatccaagccaccagaaaccttcaaataatcttgaatatactgttctttgaaattcggatcgttaaccattttcttcatagaagagaaactaaacaaggagagacctagagcctccgtatcagcacctttctcatcaacgatctccttcaaccaagtataggcctgattatagtcggcattatcgccagtttgcgctaaataatcttgcacttttcgagcaacgatccagtcttttccataccggcgatcatttccaaaatatttcacacgcttgtcgtaaactcccatcaaatcatcaataagagctttcttcttagcgggatctttctcttgggcgatcttccagcccataattttcacaccgtacaaatagatatcttttgtagcggcaggacactcatcgtacacgatcttccagaaatcaaaggcgtctttgaagtttccggctttcgcgtaaggaacgaacaagctgatattggtaatacaacgcacgctatcctcaccggaaccgaactgtgtaccattatctactcctttctgcgcataagcgcctaacgtacccatagtacatccaagcgctagtaataaaactttgatcttcatatctctttctattaaagttagctataatatttatattccttcaaaaaagtatcatactcattagaccctttcggccattcccggtttaatccacttttcgtttaaaaaaccataattcgttaaatgtatagttcaccgtaaaccggaaatactgctcatcaatcattgtacgtaattccggacggatcttcacgtattcaaatgacaggttcactaatgaacggttatcgatcaatggaagcccaaaaccgacactcgccccatattcattataaccatgtcctttataaccattctcctcggagcgactgactcttaagtacgaattgctataatgaaaaccggcacggtatctgatacgtcccagataattacgattatcataacgaggaataaattcggcaccagccgctacacgtgtacgattcttgaattgacctttctcgttatcaaaataagcgttcgcccagtcctcatataagaagtctgcggctaatgtcaaccgattctctttcacataggagatacccgctccgtaagagttcggcatatcaaaccgataattcttaattgtatcgttccttgtatatccggatgtagccgaagaaccgacaagctgagtatcatacacagtcgtattcaacttttttccgggagagtaaacgaaacctaccgtgacatgctccgtcttactcaaaggatgcgtatattgaataccaaaatctaactttaaatcacgaatctcataacgttggtttctatacacatcgtccgcccctgtcgagctcgggaaaatcaagttgcgggaatgtgttatatttccaaataaaaatccggcgttcacaccaatggaaagacgcttcttccaaatatcataggagagccctaaataggcatcgcttaagccaccttcgccactaaagctttctccccaacttaaaccgccctcggtacggctctcgccgaaatcatatcctacatatgaataaggtaataaaccgatactcatcgctaaacgccgggtgatcggaaattgcatggcgatatactccacgtttccattcatctgtcgttgcttgttcgtaccgtcatagaaccaagacacctgaccggacgcaccaaaatcaaaaaggaatgtcaacgaatccatgcaactataagatgctggatttaatggatttatctgtttagaggaccttaatccataaccgactccacccatcgcccttccggcaccaaaagatcgatccgccaactctccatatccaaatcgcgtataaggcgagttcgtgttattttgagcccacaatggcaattgtgtaaagataagaaaacttattattactaccttattaattttcaacattatactctaagattctgtttaatcctgtcaacactaaattaatgtctgcaaagatggagttttttagccgtctttcaaaataaaacgaatgaccgcctgttaaaaaaaccaaaagatccggatattttactttcagctcgtcaatatatccgtccatctcgtaaacaatcccattcaccacacccgcttggatagccgtttccgtacttctcccgataagcggtatatcatcctcttccgttaccaaaggcagtttcttcgtaaaatggttcaacgctcgaaaacgggttgtcatccccggagagatattcccccccagaaagatacccggcgcttctatcacctcatacgtgatagcggtaccggcatcgataaccagcagattttttcccggccgcaaataattcgcccccacgacagcggccaaacggtccttgcctagcgttttcggcgtcccatattccaccttgatcggtaaagctacatgttcatccagaaagacaaaacgctgaagcttattttttagataagcgatcaactcatcgtccgtatctatcaccgtcgataaaatgccttgcgtaaaagcgtacttctcaaaaagagcagcgaccacagatacaccgaattgcttgtatacaaaagaagcctctatatgcccatttttatacacagcgacctttgatgacgtgttaccttgttctataataagattcacttctctgatattttccgcaaagaaaaacaaaaatgatgaaataacacgcaaaaacatcgcataacctctaaaattcttcttgaacaaaaaggatcgcatctctgtttgaagaaaaatctaaataaaaaacaagttatgaattacgggattagtgtcttattcagggcgattccattgctaatggccctcttttgtttcggttatggattttttgtctttaactatggagtggactccagcagattcgtcgccggacctgtcgtattctctcttggctttatttgtatagctttgttcgctacggcagcgaccattattcgtcaaattatccacacatataataatgtagccagattcgctttgcctatccttggatatctctcggcaaccatcacttttctggcgggctttatcttactcatgtcctcaccggcgccagcagactttgtcgcgggccatgtcatttgcggggtgggccttataaccgcatgcgtagcgacaacggctaccgcctctacccgattcaccttaatacaaatgaacgccaaaagcgacgatcccagaatacctgacaaagcgttcaacttttggcagggggtattcttgatccttgtagcatcatttatatccatagtcgcatggatttgggcttaccggttgctagcgcatagcgacgagcattcccaatactttgtcgccgggcacgtgatggccggactagcatgtatttgcagcagcttaatcgctttagtcgccacgatcgcccgacaaataagaaacacatattcccgattggaaaaaaggctatggcaccgttttgtcatcctgatgggatctatcagtctgatatggggtctcttcgtattaggagatagcgacccggctaatgcctcaaccggatatatcatgatcggccttggattagtttgctatagtatctccagcaaggtgatcttgctgtctaaaatatggagggaagaattcaagcttgccaaccggattccattgattcctatattcacggctttattctgccttttcctctccgctttccttttcgagacggcggccgagcatagttattatgccattcccgcacgggtattggccggactgggagcgatctgctttacgttgttctccatcgtcagcatattggaaagcggaacctcttccaagtaaactgttttttcatcgtgatgaaaatactttttcttcacggtgaaaatactttttcttcatgatgaaaatgtttttcctcacaatgaaaaaatcaacattctttgataaaccatcggccacaacacataaaacattctttaacactaccaaaagcataaggttttcaattctttataaacaattatcatcccaagagtaagaaaacgcttgcaaagtaaaaaataatatctacttttgcacccgggtaagtcctacacggcatgctccctcggaatcccccagggcttgaccgcagcaagggtacttggttgtagcggcgcgatgtagtaagcttacccacctgcctctttagctcagttggccagagcacgtgatttgtaatctcggggtcgttggttcgaatccgacaagaggctcagataaaacacaacttaaaaggaagcttatacgtaggcttccttttttctattttagacataatatagttgcgcatttgcattaatatattaactttgctgataagaattcaaaacagcaacatcatggaagagaataagaatttacttttaaaaggcgctatgacttatggtttggccatgggcatatattgggtagtgaaatacatctttttcatcttcagcgtttccgtcccctccttgagtcttgtctattggctattgacgctcgccgtccctttcatcgcctactacatgacgaaaagatatcggcacgacatcggtggaaggatcagtttctttcatgcatggagattcggcacgatgttgtattttttcgccgcattgatcgtctcgcttgaatactttgtcttttatcagttcatcgccccacctgatttcgtggcaaatgcgatcggacaattaacgactgcattaaaagatagccaagttagctcggatatgctcgactcgctcagcaatattcgcatctcgccaatccatatggccatacaaggaatatttaataacgtattttacggcatcatactttctataccggtagcggctctcttgtgcaggaacaattcgactggttccatcactgaaaaccgctaaaaagttaattacagacaaataatggacatatcagttgttatcccgttgtataacgaagccgagtctttacccgagttattctcgtggatagagcgggtgatgaaagaacataattatacctacgaagtcattttcgtgaatgacggtagtacggataattcttgggaagtgatcgaggagttgaaacaacgttctccacatatccggggaatcaagttccgtcgcaactacggcaagtcgccgggattgcactgcggattccagcgggctaaaggtgacgtagtcattaccatggacgccgatctacaggacagcccggatgagatacccgaactttaccggatgatcaccgaagacgggtacgatctggtatccggttggaaaaagaaaagatatgacccgttgtctaagacgatccccacgaaattattcaacgcgacagctcgtaaattctcgggaataaagaacttacacgatttcaattgcggattgaaagcgtataagaatgttgtcattaaaaatatagaggtgtataacgatatgcaccgttacataccttatttagctaagattgccggatttcacaagattggcgagaaagtagtgaaacatcaagcccgcaagtacggaactactaaattcgggttggatcgcttcgtgaacggttatcttgatttgatcacgctttggtttacttccaaattcggaaagaaaccgatgcacttcttcggtttatggggaagcgctatgttcttcattggttttatcgctctagtaatcgtactcagcatgaaattgatctcgatgtactctggagatctaagacctttggttacaagttccccttatttctatatttcattgacagcgatgattctgggaacccagatgttcctagcgggctttatcggggagttgatttcccgcaattctccgaatcgcaataactataaaatagaggatgagatatgagtttcctagaattagcgagaaaacgttgctctatccgaaagtatgcccccaaaaacgtagagcaagaaaagattgattatatcctagaagcagctcgtttggccccttcggcggtaaattatcaaccttggtattttgtatgggttcaaagtgcggaaggaaaagctaaattacaagaatgctatccccgggaatggttcaagcaagcgccttattacttgatcgtttgcggagatcatcagcaatcttggaaacggagcgatcataaggatcatatggatatcgatacggctatcgccacggaacacatttgtttagccgctgccgaacaaggattgggtacttgttgggtttgcaatttcgacacggagctttgccgtaaacattttaaaattccggaaacgatcgagcctgttgtactgataccgttcggctatccttccgacccggcattattcgatgagactccaaagaaacgtaagcccatagaagaaattattaaacgggaatcattctagtatgttatacattgaagttctgctactagcgatcggcttatccatggatagcctagcagtatcagttaccggcggcgcagttcttaagaacaactgcaccgccggtaatattattaagatagcgagcgtgctcggtatattccaagccggaatgaccgtgattggttatacgatgggattaggattcgaaaaatacatttgcgccttcgatcattggatcgcatttaccctcttgctttacttaggtggaaaaatgatatacgatagcacgaaggaagaggaggaagacgggaaattcgatcctctatgtaaccggacattatgcggattgggaatagcgacaagtatcgatgccctcgccgtaggaatctctctggcgatcttaaaatcaccgctcttgctgcaagcctcgactatcggtgttgtcaccttcgctatctctgccttcggcgtctatttcggtaaccgattcggcaagagaatcgacttgaagctggacctcatcggaggtttaatcttaatcggtatcggtacaaagattttgatagagcatgtattctttagctagggataccttattgaataaataaccttatacattaattaatagacatgaaaagccagcaattacgaaaactagcgccggagctggattcactccggctaggcagcggttggaaaatcgacgaattgagtaaaccgcaaatcattgtagaaagcagttacggacatagccatccgggaagcgcccatctggataaattgatggacgaggccggaatcggtataaaggaaaaggggggacgtgccgcaaactacttcgtcactgatatttgtgatggagaggcgcagggacacgatggtatgaactactcattagtctcccgtgatatcatggccgccatgatggagattcatgtaaaagcgactcctttcgacgctggtgtctttatagccagttgcgacaaatccgtccctgcgcatttgatggcgatagcccggctagatatgcctgctatattcatgcctggtggtataatgaaagccggtcccaacctactcacgttagaacaaatcggtacctatagcgcccagtacgagcgaaaagaaataacggaagaacaattcatggtttataagcgtgacgcatgtccggattgtggagcttgctctttcatgggcactgcctctacgatgcaagtaatggcagaagcgctaggcatcgctttaccgggttccgccttgatccccgcccatttacccgagttaaaagaaaccgcccgtaaagccggagaacatgcgctcggactggcgagagaagagttaaaaccctccgatatcatgacgatacaagcgtttgaaaatgcgatcatggtacatgccgccatagcgggttccagcaacagcctgcttcatcttccagctatcgcccatgaactgggaatccagttatcaccggatttgttcgacaagatacatcgtaagatcccctaccttttaaatatacgtcccagcggtttttggcccggcgaatatttctggtatgcgggaggcgtaccggcgatcatgaaagaaatcaaggaattcctccatctcgatgtcaagaccgttaccggcagaacattgggagaaaacttaaaagatttacagctcaacggcttctatgagaattgccataaatatcttcctgccctaggagtaaaggttggcgatattatcaaacctcttcacacaccgatcaaggcacaaggagccatcgctatattgaaaggaaatttagcgcccgaaggggcagtcgtaaaacattcggcgatttcaccccgcttgatgcaagtcaccctgaaagcgagggtattcgattgtgaggagaacgctattgaggcggtattacaaaagaaaatccacccgggagaagcggtatttatccgttatgaaggaccgaaaggaagtggaatgccagaaatgttttatacgacagaagcgatcgcctccgatcctgagttggtagagaccatcgcattgatcaccgacggtcgtttctccggagcgacccgaggcccggcgatcggacatgtatccccggaggcttccgaggggggaccgatcgccttggtagagaacgatgacttgatccgtatcgatattccagcgagaagattggatataatcggtaccggcggtatcgagagaagcgcggaagaaatagaaaagatcctatccgaaaggcgtgcacattggataaaaccagagtcacaatataaaaaaggaatccttgatatttatacacacaatagcgtctcccccatgaaaggggcatatatggaattttttatgtaagttcgcgacataaaatttcataatgatgcgcaagaatatttccatattagtcagcctgttgatcttatcgcttacggcttgctcggacaagggccaatatttcgaagagagtggttctgtttttcatacaagttaccacatcaaatacaaggccaagcaaatcctaaccgataagatcgacagcgagctgcaacgttttaacctctccttaaatcctttcaaccccaactccacgatcgctaaagtcaataataacgaggatgtggaggtagatgaatggtttaccgaagtattcattaaggcggaagaaatctccaaaaaatcaggaggagcttttgatattacttgcgctccattaattaatctatggggattcggattcagtaagatggacagcgtaaccccgcagatgatcgatagcatcaaggctttcgtcggttatcaaaaagtaagattggaaggaaagaaaatcatcaaagaagatccccggattctattgaattgttcgtccatcgcaaaaggttatgcttgcgatgttatcgcccgcctgctggaaaaagaaggcgtaaagaactacatggtagaaataggtggtgaggtcaccatgaaaggcgtaaatcaacaaggtgactgttggcgagtcggcatcaacaagccggaaatagggacaagtggcgtaacaaatgatgttgaagagatcgtacaattatgccaaaaagggggggtggctacttctggtgactaccgaaacttctacatcaaggatggtaagaaatatgcccatacgatcaatccagcgaccggttatcccgctggacaaaatattcttagtgcgacaatcgtggcggaagattgtatgacagcagacgcttacgctacgactttcatggttttgggagtcgagaaagcgaagctactggcacaatccatcccccaaatagagtatttcattatttatgcggacaacaacggacaacagaaagtcacctactcaaaaggtatgttggaataccttcctaacagaaaaacattggctatcctcgaaaatccttaagttcctacatgaagcgttatctaaatcaacttgaatgcaaaatactgagagccggagattccctgtttaattccacaaccacggataacctattaatcttcgtattttcgggaaaacttattatttacagccaagaagggacacatatagcggaagtggcaaaagatcatttcatgctacttgcgcaaaacaccaatcataaggttatagcctcagcccctacccgccttatcttaatacatgcgggcagtctatccgacatgatcataaatgacccggaatggaatgtggagaaaccggtcgtcttaccgattcccccagccttagcgcacacattaaatcagatagaatattatatgaaggataaatactttaccttgaattgagattaaaaatgtttcaattcctgataaagcttttgcacaggtaatcccatcacgttataaaaactaccattgatagcctctaccccgatataaccgatccactcctgaatgccataccctcccgctttatcataaggtttatatttatccaaataataattaatctcttcatcacccaatttagcgaaacaaaccgcagattcgacggaaaagcctacatttttgtccttcgtcatgatacaaacaccggttattacctgatgtacatgatccgacaaagcatgaagcatagcataagcttcctctcgattcgcaggctttcccataaccccgtcaaacgtccaaacgatcgtatctgccgtgattagcaattcatcatccgccatagtcggtttataggcctccgctttcgaacgggcaatatataaagggatctccatggagtcaatagaatccggataagactcgtcaatatccgaaattaccctcacctcgaagtcgatatccagaccagataacaaattccgtcgtctcggagaattagaggctaagacgatcttgtacttttttaaattctctaacataacctattcgattaagcgttacacattcaccaaaattttaccacccaaaagcctcctcgccgaaccagtgtccttgagcccgcatcgtttgctcgatcacgtccctagctacgccttcgccacctcgccgggaggatatatatttcgctatctccttgatctccggagccgcatccgcaggcgccaccggcaatccgactcgcgtcattacctcataatcaggaatatcatcacccgcatacatgatgtgctcaggagacaagcccgttttttccatgaaatccttaaagtcatgcacctttacagcgctacgcatataaatatgttgtattcctaaacgagaaaagcgaatctgtacggcttccgtatatccgcccgtaattatagcgacctcataacctttcttcacggccaattgcaaggcatagccatccttgatattgacagtacgcatcggatcgccattcgggtgaagcggaatcacatcgcaggatagcaccccgtctacatcaaagacaaaagcctttatttttctcaaatcatagtttatactactcatgtcgagcctccttatgtatacttcggctaatcagctcatatagatttcgcatatccggatctttaagcatagccatatgtttgtttatcacattctcgtcatatcgtatagctggtcccgtttgggctcgcaccggcgacattacatgtaccttagcggctgtctcgtctatcaaaggtagcaagacctctcccggtatttgctgttcttccaagatcttttcagctagcgcatacatatgattcgtaaaattacaagcgaaaaccgccgctaaatgtaagttctttcgcttctcggaggagaggaaacggacatcactggagagcgccctagccacctcgcccagcaccttctcatcttcagacgagttcgcctctaaaaagaacggtattttcttgaaatccacttccctactcttactaaacgtttgtaacggataaaccaccccatatctagccgtaagaccttcaaatacagagataggcatactccctgccgtatgcacccacaaaccgttattcggttttacacgggcgataacatcttggagcacggcatctttcaaagagaaaacatacaagtcggcatcttccacaatctcttccgggatcacggtccacccacatcccaattcatcagctaaaatcttagcatgctcgcttgtgtgactatatacttgcccgatactcattccagacttacgcatttccaacgaaagccgggtagctaagtttccggcaccaacaaatacgactctcattctcccgtctctttattttcttccggaagagagaactttcctatatgtatcttctcccattgtaaatgggattcatcaaaaggcttacgaacctgatccttataaccgataccaatgatagacaagacatccaattgataagggatatccagcaacgaacgaacataattattcgaatcctcctcgtcctctgttacccggttccggatctgacaccagcaactgcccaatcccaaatcctctgcttgcaattgcatataaatagaagcgaccgaagcgtcctcgatccaaacatcgctttccatcacattcgccaagacaaccacggccaaggcacaaccctccagaaaagcggaaccatttttcttacacccggcaagtttcttcaacatttccttatcttccacgaccacgaactgccaaggattactacgttttgaggccggagccatcaacgccgccttcaagatcagttctacctgctcgggtgaaagtagttgttcggtaaacttacgtgtacttcttctattttgtataagtgttgcaaaactctccatttttttcgttctttgtactcttttaatattaagattcgcaaatataaatataattttttgcacccatatatacgtatcgttcttttttctcgttagtatttttataattgaacaatagattatgaagattcgtgcgatagccgcgctgctatttatacttatttccgtgagtgcctttggcgaaggccgcataaaaatcactggttatgtccgtgacgccgacggtaaccctctggaattagtgaatgtccgggttaagaacacgttgatcggctccatgaccaacgagaagggatattattccttttccatatcgccgggggattctatctccattatttactcttgtctgggatataataaagctgaacgtatcattccttcagcacaagccgatatgcgcctgaacgtacagatgaactatacctcatttgatttaggggaagtatctgttactgccatccgcaagcagaccacgaccatggagtccctaaatgcggacaaaatcaagttattgcccgatccttccggaggtagtatagagagcttggtcgttacgtttgccggagtatcgtccaataacgagttaagttcccagtattccgtacgtggaggtagttatgatgaaaatatcgtttatgtgaatgggatcgaggtattccgtccacttctgattcgctcgggacaacaagagggccttagctttatcaatccggacctaacggaggcggtcaatttcgccgccggtggcttcgaggctcgttacggagacaagatgagttctgtgctggatattacctataaaagacctaagatattcgaaggctcggcttctgcgagcttgttgggcgcgaatgcttatgtaggcagttctatcggtaaatttacccaagtaacgggtttccgctttaaaagcggtcggtctattttgggtaccatggatacagacgcagaatacgaccctaaatttatcgatttgcaaacttacatcacgtaccaattggcccctaaatgggaaatcaatttcttgggaaacctcgctaacaataattataaattcaccccttatagccgggaaacctctttcggtacagccgagcatcccaagaacttcaaagtctatttcgacggaagggaaagagaccgtttccaaaccttattcggtgcgcttacattgaaacacaaccccaatgagaacacagagttgggacttcaagcctccgctttcaaaagcaaggaagaagagggatacgatatcgccggagaatattggctgagcgagaacggagcggaaaatccgaatgacgacgcgtcagccgccatgtccgtaggccgttatcacgagcacgcacgaaaccgtttgaactccaccgtcatgaatgtcgggcactatgggatggcccgccttttaaacaatacgttgaaatggggagccacggtacaaatggagaaaatcaatgataagatcagtgaatgggaaaaaagggattcctcaggttattctttgccccaaaccggtaataacgtaagtgtatattcgaacctcttttctgataatcagatagaaagcacacgcttttccgcttatgcgcaagacgcattcaaattcaggaccaagcaaggtctgttcacgttagtcgcaggggttagaggtagttattggacttataataaggagttccttttcagtccccgtgcctcattgggctttatcccgaacttcgaccaagacttgacgctccgtttcgccaccggactgtattatcaatcgcccttctacaaggaattacgtaaagtagacaaagataagaacggcaataatatcacggtattgaacaaagatctaaagtcacaacgctccatccatttcatattgggaggagattatacgttccgtgccgtagaccggaatttcaaggtgaccgccgagatgtactataaaaagctggacaatctgaatccctacaccgtagataacgtcaagatccgctattacggtgagaactgcgccaaaggttacgccatgggactcgatgtcaaattcttcggagaattcgtaccgggtaccgactcatggatcagcttctccttgatgaaagcccagcaaaccatccgggaaacaacgaccgttcctatggccaatagccaaggctacaacatctcactcttcttccaagattatttcccgggctataaacgagtcaagctaaatctgaaaggagttctatccggaggacttccccagacaatcccgggcaaaggatacgaagccggctatttccgtacgcccgcctacaaacgtgtagatatcggcctctcctatcaattggcaggaggcacggacgctatcatggacaggggcttcttccgccatttgaaaaacatttggctaggtctggatgtgtttaacatattagacatcaaaaacgttagttcctactattggataacagatgtatataatgtccaatacgcagttccaaactatctgaccggacgtcaattgaacgttcgtctgattgtcgatttttaataaaatgtatctttaaacacatttactgggagataaaaacaaaaaattatttcctcattcataaaaagtagtgtacatttgcacacaatagaaacaaacatttactaaatctttaaattattattgacatggaacttacacatatcgaacatttaggtatcgcagtgaagagtatcgaggcttgtttaccctattatgaaggcgttcttggattaaaatgctacaatatcgaagtagtagcagaccaaaaagtaaaaaccgcatttttcaaggtaggacagactaagattgaactactagagccgaccagcgaagatagcacgatcgcgaaatttatcgagaaaaaaggtgaaggtatccaccatatcgcattcgcggtacctgatgtacaggcagctttgaacgaggctgaggaaaaaggcgttaaattaatcgataaagctcctcgtggtggcgcggaaggcttgaacatcgctttccttcacccgaaatcaacttgcagcgtattgacagaactttgcatgccgggcaacaaataattaatccgttcatttctaacaacaaatcaaaatacaatgagtaaccagcttgaaaaagtaaaagagctcatcgcacttcgtgagcaagctcgcttgggtggaggagagaaaagaatcgaatcacagcacaaaaaaggcaaatataccgctcgtgagcgtatcgccatgttgcttgacgaaggtagtttcgaggaattcgacatgtttgttcaacaccgttgtacaaacttcggtatcgagaaaactaaatatttaggcgatggtatcgtaacaggttatggtacgatcgacggacgtttggtatatatcttcgctcaagatttcaccgtattcggtggagccttgtctgaggctttggctatgaaaatctgtaaagtaatggatcaagccatgaagatgggcgctcccgttatcggtttgaacgactctggtggagctcgtatccaagaaggtgtaaacgccttggcaggatacgcagagattttccaacgtaacatcttggcttccggtgttgttcctcagatttccggtatcttcggcccttgcgccggtggagccgtttattctccggctttgacagacttcaacatcatgacacgtggtaccagctatatgttcttgactggtccgaaagtcgtaaaaaccgtaacaggtgaggatgtaacccaagagcagttgggtggagccagcgtacacactacaaaatcgggtgtagcccatttcgctgttgatacggaagaggatggtttgcaattgattcgtaaattgctcagcttcttacctcagaacaacttagaggaaacgccgttagttgagtgtaaagacccgatcgatcgtttggacgatgtattgaatgatatcattcccgataacgctaaccaatcttacgatatgtatgaggttatcggtacaatcgtcgataacaacgagtttctagaggttcatgcggattacgctaagaatatcatcgtaggtttcgctcgtttcaacggacaatctgtcggtatcgtagccaaccagccgaaggttatggcaggatgcttggatagcaacgcatctcgtaaagcaggtcgcttcgttcgtttctgcgacgctttcaatattcctttggtaacattggttgacgttccgggattccttccgggtacaggtcaggaatacaacggtgtaatccttcatggcgctaaattgctttacgcttatggtgaggccaccgttcctaagattaccgttacattgcgtaagtcttacggtggagcttattgcgtgatgagttctaaacatttacgtggtgatatgaattacgcatggccgacagccgagatcgctgttatgggcccgagcggtgccgtagaggttatcttcgccaaggaagtagcagccgctgaagatccgaaagcatgcgcagcagagaaagaagctgaatataagaaagcattcgctaatccttataacgcagctcaatacggttatatcgacgatgttatcgaaccacgtaacactcgtttccgtattattcgtgctttgcagcaattgcagactaagaagttaagcaatcctgctaagaaacatgataacctgcctctataatccgtaaaacaggagatgaatatgataaataagaaaataggggtattgctactgttcgctttgctcatttcattcggggcaaaggcacagcgcgcaacctccatgcgaattaatgaagtattggttatcaacgaggataacttcgttgatgactatggcaaacgtcatggctggattgagttgttcaacacttcggccggaacggtaaatatcgcgggatgttatttgacagacgacaaaaacaatcccatgaaatatccgatcccgaagggagacgtattaactcagatccaaccccgccagcacacactattttgggctgacggacagccggacagaggtacattccacgttaacttcgtattagatccctctaaggagaattatatagctctgtatgatgcagatggtaaaacattgatcgacgaagttacgatccctgccggacaaatggctgatatcagttacggtagagtgatcgatggtaaagatgaatgggcacagctgaagaaagttactcccagtacgaataacctaacattggattctaatgagaaaatcgataatttcaaacagaatgactctttaggtatcggtatgaccattaccgctatggctgtagtgttcttgggattatttttgttatacatcatctttaagcagatcggtagattgtctatatccgcaagcaaacgtaacgctcagaaagctgcgggaacaacaagtgtatcggttgacgccggacaagagtctggtgagatcttcgccgctatcgctaccgctttgtacgagatgagtgatgacaatcatgacatcgagcacacggttcttacgatccacaaggtacaaaggacttattctccttggagttcaaaactctacggtttgcgtcaaaccccacataagtaattatctaaaaacgaacaaagaatgaaaagttttaaatataccattaacggtaacgtatataaagtacacatcaattctgtagtggatgacatcgcagatgttgaagtaaatggtacaccttatcaagtaaaattagagaaaccggcgaagaaacaaatggttacattgaaacgtccggctcaagcaccgacaacagcaagtggcgaccctgtagttactcgtccggcagcctctactacacaaggcgctgttaagactccgctaccaggtgttatcttgcaggttaagtgcaacgtaggtgatacagtgaagagaggtcaaacattgattatccttgaggctatgaagatggagaacaacatcaacgcagaccgtgacggtaagattatagaaattaaagtacacaagggagactctgtgctagaaggtgctgatctcgtagtaatcggataagactatgcaagagagctttttaacattcttaggtgagaacttacaactgttccttacctatacaggtgtatacaacgctactccgggacatctcatcatgattctggtaggtctgttgtttatattcctggcgattaaatatgagtttgaaccgatgcttttgatccctatcggatttggtatcttgatcggtaatattcctttcaaggacgcaggtcttcaggtaggtatttatgagcaagggtctgtactgaacatcctctatcagggtgtgacctctggatggtatccgccattgatcttcctcggtatcggggccatgaccgacttctccgcattgatctccaatcctaagttgatgttgatcggtgcagcggctcagttcggtatctttggtgcttatacgattgctcttcaaatgggatttgagccgaaccaagcaggtgctatcggtattatcggtggtgctgacggtccgacggctatcttcctttcttctaagttagcgccaaacttaatgggtgcgatcgcggtatccgcttactcatacatggcgttggttcctattatccaaccgccgttcatgagattgcttacgactaagaaagagcgtttgatccgtatgaaaccgccgagagccgtttcttccacggaaaaaattatcttcccgatcgttggtttgttgcttacttgcttcttggttccgtccggtttaccattgttaggtatgctattcttcggaaacttattgaaagaaagtggcgtgactcgtcgtttggcagagactgctcgtggtccgctgatcgatacaatcacgatcttattgggtatcacggtaggtgcttctacccaagctactcaattcttaacattgaactctatcaagatcttcggtttaggagcattgtctttcgtgatcgcgacttgtgccggtgtattgttcgttaaattgttcaatttaatattgaaagacggtaacaagattaacccgcttatcggtaacgctggtgtatctgctgttccagactcagctcgtatctctcaagtcgtaggtttggaatatgacccgaccaactacttgttgatgcatgctatgggtccgaacgtagcaggtgtaatcggttccgctgtagctgccggtatcttgctaggattccttggttaataaaacaactatctatattaaaaaaggcgaggtccgaaaggatcccgcctttttatgttattgttctcagttagcttgctctataggaaccggactaatctccgtactcgtatcctccaccaacgttgtcccgaggaacaaccagatcatcaaaaggattatagcgacaaccacaccaaataccaatagcgtattcacacttttctttctcatgtctttaactgatttattcattttagaataaacagccggaacatgaatttggttgtgtacccttactcttatttgtttttccctaacgcctcgttcagcactttgttcttagcgatcgttgcttggaattctttcaaatagaaaggctcaaaataagccacattctcaaaacggccatcatcatatgctttctgcgacaaggatgccatatttacagccaatggatagataccagccataaaacaggcgttcggagaagtgattaccatctcacatttagcggcaccgtctccaaagaaacaaaccttaccgttctctaaaaaagaagcatacgaatcagcatctacgatatcagcagtcgtggcacgtatcgtgttgagatgggaatcataaatcgaagagtagacttccatacggcgggcatccaacatagcgcaatacaagcaatcggcctcctccttatttttccggatagcggcagacgctaaaatatccagcgtatgaataccgatcaaaggaataccatacccaaagcataatcctttagccacagacaccccgatgcgtaatcccgtataagatccgggtccgctacttaccgccacggcatccagtttcatccctttcgacttcgcggcctctaatgcctcttccatataaacgcccaataacgccgcatgagacggcccctcaaaggaagccttctcaaagaccacctcctccccttccgacagggctactgaacatacggaagtggatgtctcgatatttaagatcaatgacataataattaactattaacaattgataattgaacgaacaaacaatctcaatccttcaatctgattaggttgcgaaggtatacaaaaattcattatactatcaaggcagccctatgagaaacatctatttatgagaaaataaacatcaaatctaaaaggaaaccactatctttgcgcaaacttttgagaaaaatgatacaatcaatgactgggttcggtaaggttactgccgagctcccttcaaaaaaagtaaccgtagagataaaggctttaaacagtaagcaattggatttgtccacccgtatcccttccatatacaaggataaggaaatggagcttcggagcctgttacttcaatctttggagcggggaaaagttgagttcaatatctttatagaatatataggcaaagatactcctacacagatcaatcttgccgccgtagagaattattacaaccaaatcaaggagatcgcagagaaactgaatatcagcgttccgaacgattggttccagaccttgctccggatgccggacgcaatcaagtccgagaccgtagaaccggacgaatccgaatggggggtggttttagaaacggtaaaggacgctatcaagcacctgtgtgatttccgtatccaagaaggagccatgcttcaaaagctttttgagcaaaagatagccaatatcgccactctgttgaaagaagtggagaaatacgagggggaacgtatcgagaaaatcaaagctcgtatcatggataacctgcaaaagatagccgagaaggactatgacaagaatcgtttcgaacaagaaatgatctattacatcgagaagctggatgtcaacgaggaaaagaaccgtttggacaaccacttgaaatattttatctcaaccatggaatccggtcacggccaaggcaagaagctcggttttatcgctcaggaaatggggcgtgagatcaatacgctcggatcaaagagcaaccacgccgagatgcagaagatcgtggtccagatgaaagacgagttggaacaaatcaaggaacaggtactaaacgtattataataagattaacgagaatggctggcaaattaattatcttctccgcaccctcgggttccggaaaatcaaccattattaattatcttttgaaacaagatttacaccttcgtttctccatctcggctaccagccgggctccgcggggaaccgagaagaatggtgtggaatattatttccttacgccggaagagttccgcagtcgtatcgctaatggagacttcttggaatatgaggaggtgtataccgataaatattacggtacgttaaagagcgaggtagagcgtatcttgaacgaaggggataacgtgattttcgatgtggatgtggtaggcggatgcaatatcaagaaattctatggagaccgtgccctgtctgtctttatccaacctccttgcatcgatgacctacggaagcgattggaaggacggggaacagacagcccggaagttatcgaaagccgtatcgccaaggctgagtatgaattagggttcacgggacagtttgataaggttgtcgtaaacgatgatctggagactgcccaaaaagacgcgttgaagatcattcgtgagttcttaaacaaatagtctatgtctaatatattcaagaatacccgttttatgatggggctttctatcgtttgtgggatagcgagcctcgtattaggtggtattagcctgtattataaggagtatatcatcgggggtgccctgatatttaatatattcatttgtttcatcaactataagggttggcaaaagaagggctaagtaaaaatcgtatgggactcaagaccgggatttacagtggatcattcaatcccattcacataggccatctcgccttggcgaactggctatgtgagttcgagggattggatgaggtgtggttcgtagtcacgcctcacaatccgctgaagaaaaaggatgacctgctcgatgactcactacggctggaaatggcccaagccgctattgacggatgtcctaaattcagggtctgcgatattgagttctacctaccgaaaccttcttattccattgataccctacgaaccttatcccgtaactatccaaatcgggacttttattttatcatgggagccgataactggcagctttttccccgatggaaagaacacgaaaaaatactccaagactacaaactgctgatttatccccgcctaggattcgacatctcgatccctgccatttatccgaacgtgaaaaaggtagacgctcccttgatggaaatctcctccacatttatccgtaacgcttaccaaaccggcaaggatatccgtttcttcctgccggaaggagtgcggccttatttcgggtcagtagcaaatcagtgacatacctgcgatagaagatatacttacttgggctatgaagtatatatcctatgccacttgaagtatatattcttcgagaagggaagttataccgtgattatttacagctttgccatcttagggcaatctgccaaaattcccattaaaacatgttttacagcacagccgttaaagatgatccccgtaacatcaaaacaggctcacccgataatctttttggagtatccaaatatataatttgagccttgtcaagtgaataactaatggctagtcaagtgaataactaacggttaggggtagccgttagttattcacttgggaagtgattagttattcatttgggaggctttgtacctatagcttacgctattacataaaacactattacataacaaattacatcaatacaataagtcatttctcgaacaaattaaacgtgggacagaacaatcgaattcacatagctaacttatatgcatatctccactaattttctactgtagcaatagaaagacaatatacattaaacaacaataaaaaagacataatataccccatgtttgatattttttaattttctttgtaatatcaaagtattacacatctattaactttttaaatctttcaaattatggacaaactcaaaaaaactgacaaaagtcgtactaaaccaacaaagtaaagttcttccaaaagaacaaatgatgaaaatcttagggggaggaagtgcgtattgtcattgtcataatctttcttcctcaattgaagtaacaagctgctctgaatgcagtaataaatgctcaaattatggcggcgtacaaaactgtaacactacaggaggttagcaacaaaagaaagggctggttttagctggtgatatctgctaaaaccagcttttttcttaaaacaaaaatgaccatgatctatcttctatttttagtcactcttttgcttatcagttgtaatccggatcaagccaaggataatggcaaggacgaaacaatcgagtattttattccactctcacatcgggtagaaaaagacgtggatgaaatgtttgaggaatatcggtatgtcccccttggaaacaagggatgacgcattgatagatgtgctttacaatgttaaaaacatcgctatctttcaagaggatatttacataggctccggagagcaattaatcgtttgggataaatatggaaaattcaaacgagtcttatccaaaaagggaaatgatccgcaatcatacctccactttaaccatttcatgatatggcccaatggagatctatcgatcgcttctcccattgaaatcgtaacctattcaaattcacaccaattcatcaacaaaaagcgttgcgagaatgtcggctatatagaggcgatcactcttttgaacgatagtctatacatcataaaatgtatgcctacccccgaacagctacgataccgtatcatcaaccatcatacgggagccattataaactcgtatgattccatcatcaactgcaatcgatatatcagttcattcacaaactcatttgaacggtatgaaggacatattatctctcatggttatcaaagcaacgacatccttgaatgcactttggatagttcaaaaatacgatacaaaataaacgtagataacaggataccgcccgccggcttttacacgcaagagggaaaagaaggcatgcaactcatacaggaagaagcggagaaaggatacatcggccatatcccggactacgtggagtccaaggaaacgatattgctctcctttaaggggaaaagagaagacctaaacggaatagccttaatcgacaaaaaagacggaaacgcaagagttttagagaacatcaagttcgatgacaacttccggtggttgcccaaacagttcttctcgttagatgagggctggtgcgccatgctgatgtatccggaagacgttttgaagaaggaagagttcgcaaggcgtttccccggactggacgaggagagtaacccggtgttgttcattggtaaactaaggtaatcattaaagacctaaagcaatggaacatgacaatctattcatccaaattttagaaatcttatcgataaagtacacggaagattttaccataagattctacgagagccatccacacaaaaacaatctgtttggactgtccgagatgctacgttattataatatagagaatgtagcggccgaaattcaaaaaacacaagaaaacttatcctcattagatgtaccctttgtggcttacgtagatcatgagtttgtattggtgcgacatgtttctaccgaggcaatcatctattcatggcgaggtaaaaacatcacattatctatcccggtattcttggaacgatggtcaggaatcgtccttcttttcgaatccaccgatgaatctattaaccggattataaagaacatagaaagaatacttacgacagcggatagtaatcgtatgtttcgtatcattacttctatcattaatagggtgtgcccttatcaccaacagaggaatggagataggaatctgggggttatggggtgttaatgtgatcggagcatctttctgcggtatcctgctttctcgagagatcttaggctcggataaatatgtcaacaaaatttgttccctgtttttgaaatccagtgattgcaacgggacattggattcccaagcatctcatttcttggggatcagttggagtgtcttcggcttaggatattttctttccgcaatattgtttatcgccttgttgccccaatatgttatatatgcagagactctgaatataatcgcattaccttatacagcgtggagcgtatggtaccaaaaatttagggtaaaacaatggtgcgctttatgtttatctgtacaagctaccgtatggatcacctttcttatctctctattcgcgataggcatggatttcaatcaatgggatttatttgatttcactaccattggatgcgtgtatgggctcgtcattctatcactccattttactgttacattatacgtaaaagaaaagcaaatccaacgaagcaacaataaacttagcagcataaaactgaatgcctctgtatttaagagcttattaaacgaacagcctcaatatgacattgacaaaaatacaggaatattattgggcaatagggatgccaaagagtggattaccattatctctaatccacattgtgctccttgcgtaaaattacatctccaaatagaaaagttactcaaagaatataaagaagagatttgcatacaaatcatcttgacctcttttagcaaggaattagaacctagcgccatgctactgacctccatgtatctactaaataatgaatcggattatttacgattcctatctgactggtatgcaaaagggcgtcataaaaaagaggattgctataaaagatacagattaaatcctaatgacaaagatatgttagccaattttcaagcacaaaacgaatgggttaggcgcaatacaataagttccactccaacagttttgacaaatggttatttattgccggaagaatatgagttaaaggatatgtcgtatttaataaattagcatcacaaatagattcgctaaataagcatttgataggctcattacatacaagctaccctttcgggttggctcatggcaaaatgggatcactcatctatttataccatttgtatgattatacgcaagaagctatttataaagagaaggctgagcgattgctggacgatctcttggaaaacgatctctctaaaaacgcagaactcaccgtggaggaaggtttatgcggagttgcgttaggattggattatattgtaaaaaagcaatttgtagacggtgatattaatgatttgctaagtggtatcgatgatttgctattcaagaagctggttttcggaaatatggaatctaggtattccctgtctcaactcatccatttcttatattacatttataaaaggctggaaatccagacaaacgataatgagcgtttccctttcgagggcttagcaatcaagttagttaatcaattggccgatttgatagacgcctcctttttcgaggaatcctatacgttttccatttaccaatatcacgtaccgatattgatgaaaaccctgtcctgtcttatacaatatgatttttacaaggatcggatacaaaaggttttggaacaactatctctgtatatgttctcccatttgcctcatctgcatttgaaccgactatatctgttatggggcatactacctttacggaattgttcgccggattggcaaagatatgtgaacgaactaagaaaatcaatcaatctagacataatatataatagagagatcaaaggcaaggatatctatatcagtaatggatacgcttctctatatttcttgttggagggattaaaaagggacttccccgaatacaccatccctttcaatccgcacctaatttacgatcggatcatctcgtctgacgcttgggatgccctaatggagaacgaatactactataatatacacagaggattgctgaatggtttccccggtacggtgttggcattgttaaacattaagcaaagatatttatgcgaatagacttgacagatacaacatttattattcctgtacggatcgattccatgatccgtttggagaatctgttgatgtccgtggactcaatagtacgttatttccggacacgcatcttaattctggaggcctcatcataccaaaatgagattatcccctcgttaataaaagatgatacggtgaagtacactttcctcgtggataaagatcctgtattctacaagaccaaatacttgaatatcctcgcaaagcaggttgatactccacttgtttgtatttgggacgcagatgtgatactggaccaccttcaaatattggatgcggtgaaacagcttagaactaggacttctgatgtcgcttatccatatgatggtaattttttagatacgtcagatatattgagggaacattattggctccatcgtgacttagatttcctaaaaaaacatcaagcaaagatgaactctttgtacacagtagagggagtgataggcgcagtcgggggagcggtcttcgcccaaacggaaaaatacctgcaagcgggtatggagaatgaggatttctatggctggggcttggaggacggagaaagacattaccgttggttgagttttggctaccggatttatcggagtgagggctgtttattccatttgtctcatccccgggatcaaaacgggatgtaaagataaaattattgggtcttaagttcattggcctacaaacctaagatacttcaccaaggatcctaagatactttatccatgaactaacaagatcggtgacctcaaccttttaccacataagtcagcataaatcagaaatattttgtacttttgcgccgtattatacaaaataatagcataatgaatctattagaactgagtgaacaggaaataataagacgtaatagcatggaacagttgcgtcagatggggatagagccttatcccgcagctgagtatgtaacgaacgcattttccaaagagataaaagagacattcaaagatgacgctgagccacgcccggtacgtatcgccggccgtatcatgagccgtcgtatcatgggaaaagcctctttcatggagttgcaggattccgagggcagaatacaggtctatatctctcgtgacgatatttgtccggacgagaataaagacacatacaatgtcgttttcaagaaattactggatatcggtgatttcgtcgggatcaagggattcgttttccgtactcagatgggagagatttccgttcatgcgcaagaattgacagttctgtctaaatcacttcgtccgctaccggtcgttaaatataaggatggtgtcgcttacgacggttttaatgacccggagcttcgttatcgccagcgttacgtggatttggtagtaaacgagggtgtaaaagatattttcatgaaacgtgcggctatcatcaagaccatgcgtaccgccttggatgaggccggatatacggaggtagagactccgatcctgcaatctatcgccggaggagctagcgcacgtccgtttacgacacatcataattccttggatatcgatttatatttacgtatcgctaccgagttgtatttgaaacgattgatcgtcggtggattcgagggtgtatacgagatcggtaagaatttccgtaacgagggtatggaccgtacgcacaacccggagttcacctgtatggaactttatgttcaatacaaggactataactggatgatgagcttcaccgagaagctgttggagcgtatctgtatcgccgtgaacggtacgagcgagagcacgatcgacggtaagacaatcagcttcaaggctcctttccgccgtttgccgatcttggaggcgatcaaggaaaagacgggttacgacttggaaggtaagagcgaggacgagatccgtacgatctgcaaggaattgaagatggagatcgacgatacgatgggtaaaggtaaattgatcgacgagatcttcggggagttctgcgagggtacgtttatccagccgaccttcatcatcgactatccggttgagatgagcccactgactaagatgcaccgtagcaaaccgggattgaccgaacgcttcgagttgatggtaaacgggaaggaattggcgaacgcttatagcgagctgaacgatccgatcgaccaagaagaacgtttcaaggagcaattacgcttgagcgagaaaggggacgacgaggcgatgttcatcgatcaagatttcttacgcgcccttcaattcggtatgcctcctacgtcgggtatcggtattggtatcgaccgtctggttatgttgatgaccggacagacaacgatccaagaggtattgcttttccctcaaatgcgtccggagaaaaccgtaaagaaagataacgccgacaaatacgtggccttgggcatttccgaggagtgggttcccgctttgcagaaagccggctacctgacggttgacacgctgaaagaagcgaacgccaacaaattaagacaagagctttgtgagcttaataaaaaatataagttagaactgcaaaatcctacgatccaagaaatagaagcttggatagccaatgtaggagaataaaagcgtgatacgatggatttgcccggaaaaatcgcgataatgggaggtggtagctgggctaccgccttagccaagatcgtactttcaactcaagatagtatcaactggtacatgcgtaggcccgatcgtatcgaggagttcaagcagttgggacacaacccgtgttacctcaccgccgtgaaattcgacacgaacaagataaacttctattccaatatcaaccaagcgatcaaggactcggataccttgatcttcgctacgccttcccctttcttgaaacaacatttgaagaaggtgaagacctctttgaaagataagtttatcatctcggcgatcaagggtatcgtaccggatgagaatatgttgattacggattacttcgcggagtattacaaggttccaacagaaaatatagcagttatcggtggtccctgtcatgcggaagagatcgctctggaacggctctcgtacattacgttggcttgttccgacatcgagaaggtccgtacgatatcccccgttttcaagaatcaatacttaaagaattccttctgtaaggatgtgaccggtatcgaatacgccgccgtactgaagaacgtgtacgctatcgccgccggtatttgccatggaatgaaatatggtgataacttccaagccgtatttatctcgaacgctattgaggagatgcgtaatttcgtggacgccgtacacgggctggagcgggatatcaccgactccgtctaccttggcgatttgctggttaccgcttattcccggttcagccgtaaccgtactttcggaaccatgatcggtaaaggatattccgtgaagacagcgcagctggagatggaaatgatcgccgagggatattatggaaccaagtgtatgcgtgagatcaacgagaaatataaagtgaacatgccgatactggacgctgtttatgatatattgtacgagaagaaatcgccgacaacggtcattcgtcaattaacggaaacgtttaaataaaatagcatatgaaaaacatcagtttaaacatcgacaaggctctgggcactgtctccaaggaacaggtttacgctcaagaggccaaggcaatggaatgtattgccacattacataacggtaacggagcaggtaacgactttttgggttggttgcatctcccctcttctattacggacgcagagttggccgacatcgagaatacggcgaacgtgcttcgttctaaatgtgaggtggtcgtagccattggtatcggtggtagctatttgggtaccaaagcggtagtagaagcgttaaacaacagcttcgactggttgcaaaacgaccgtaaaaacccggttatgttatacgccggacacaatatcggagaggattatctttatgaattaagcgaagtcttgaaaggtaagcaattcggtattatcaatatctccaagtctggtacgactacagagccggctttggctttccgtatcttgaagaaacaattggaagatgctgttggcaaggaagaggctaaacatcgtatcgtagctatcacggacgctaagagaggcgctttgcggaccttggcggatcaagaaggttacaagactttcatcatccctgataacgtaggtggacgtttctctgttttaactccggtaggtttgcttccgatcgccgtggcaggtatcagcatccgcgacttggttgctggagctgtttccatggaaaaagctacagatgcgagtgttcctttcgctgataatatggccgctatctatgccgctactcgtaatgagttatataagaacggtaaaaagattgagatcttggctaacttccatccgaaattgcactatatcgcagaatggtggaaacaactttacggagagagcgaaggtaaagacggtaaaggtattttcccagcatccgtagatttgacaaccgatttgcattccatgggtcaatggattcaagacggtgagcgtacgattttcgaaacggttatctccgtggaagctacagatcatagcgtattggtccctacagatgaagccgatttagatggcttgaacttcttggcaggcaagcatgtagacgaggtaaacaagatggccgagttaggtactcagttggctcacgtagatggtggtgttcctaatatcaaggttaatatgccggaagtaagcgcattctatatcggtcagttattctatttcttcgagaaagcttgcggtatcagtggttatatgttaggtgtgaatcctttcaatcaaccgggtgtcgaggcttataagaagaatatgttcgccctgttgaataagccgggatacgagaaagaaagcgaagctatcaaagcacgtttataatacgatttaccccataaaaaaacggttttctcatcacgaggaaaccgttttttcgtttgaatagttttttattactcatttaattctttaagtaaatcgctcccggctttgaatttgaccgagacacgtggagtaatcattacttcctcccctgttttcggattacgtgccaatcgctcggattgttgccaaggtacaaaagatccaaatcctttcatggaaatagattctccttcccgtattcctttcgccacaacagtcggtaacgcattcactacggccctaacaacatttttcggcaatcctgtttcttccacaagagattgtactaattctcctctattcatactagataataaatataccattcttcaccagaaaagagtccgatgagaacttagttgtttaatcattgcaaatatatgaatatttggggaatatcaaaatatcatatattaaaaatcaatgcatacagaaatattatatacctaaatacaggtataattgaacccctttctgatagacaagtgagactttggtagaaatataattaataagaaatagtatacagtattatgatatcacttattcatagcaagttatagcctttgaaaattcgttattaatgcgttaactagagttctcatcgaactacgtcataatttattgattaattatctcaacgaaataaatttatatcccttatttttcaatacatctatcaactcatccagataattataaaatttatcaatccggttagggtgtacatgtaggtggatcaaaagtaagcacccatttaaaccatttttgtttcataaaatgaaattccattatatatcatatttatttaatttcaagaagctttcctcccatttctgttaattccgatttattacgtacctttgtattggtttttaagaaggtaataacatgattcaagaagcgattatccgatatctgcgtaaacacaggcaggaatccctttctcccaaagctgttcttttcgatatggatggtgtattatatgactctatgcgttttcatgcacgggcatggcatgaggtagcgacccaccatcagctaacttctcggccggaagacttttatatgttcgaaggacgtactggggaaagcacgatcaacgagctataccaacgcactttccaacgagacgctaccgccgaggagaagcaaacgatctataaagagaaagcggatctattcaatacctataatgacggtgcccccatgaccggcgccgcagaggttctaaaagaagtggaagcatctggactgcaacgattggttgtcaccggttccggccaacatagcttgatcgataagctaaaccatacctatccgggacatttcaaccgagagaaaatggttacggctttcgacgtgaaatatggcaagccacaccccgaaccttatttaatgggacttcaaaaagcgcatgcgaagcctaacgaagcttttgtggtagagaacgctcccatgggagtagaagctgccgtggcagccaatatctttacgatagccgtaaacaccggacctctccccgatcaagttttattagatgccggagcggatttactatatccggatatggaaaacttagctaaagattggaaacaaatcatcgagcttgcgaaatccacccgattgaacgagtattccaaataagcgaacataaaaaaagaggctacccgataatgaagtagcctcttcttttttatcatcgaacggattatttcacataatcagccttattcaagaaatcatagctctgctgaacgctggcaaccggatcattgtttgtatattgctcaacttcaacataccaatcctttacgttattagcgtacatttgatcgaagataggcttgaaattcatcttgccacttgcgccgatctctttctcatccttgatatggatagccttgaactggctcggacggttcttcaagtaagcgacaggatcaccaccacccatcattacccagtatacatccatctcgaagaatacgtggttcgggcttacgttatccaacaagaaatcatagatcaattgatcgtcgatcttacggaactcgaagtcgtggttatgataaccgaacgcaatgctagcggcagcggtcttataaccaaccgtgttgaaataatcgcagtacatcttcaagtcatccaatgtagtcttatcgttaaccggcatccacggttgaaccatatatttaacgcctaactcattatgagcatcaatcgcttgatcccaccaactcataacctcggcttctttttctttcgtaaatgcctgtccaaggtgagcgctcgtacacttcatacctaggtcattcaccattttcttaaattcagcgggagctaaaccgtaaatctttccgttatcatagcttgctgtctccagattcttataacccatcttagcggcggtttccaatactttctggataccttcttcttttacaaggtctcttaaagaatacaattgaagccctatatatttagaagactccgatgctgtagcggcagcttgtcctgatttaccgccacaagaagataataactgcggggctaccaacccacccgcaagcatcaaagaggcttgcttcaaaaaattacgtctgttctgcatagtactattaattaagtttgattgagaatttttacaaaagtaagactatattcttaggtttatatctttatggaagttaaaatcttcaaaaaggacattgtattttaattttcgttatctttggaggatatattattacttaaatcatttatatcatgaaaaaattatcaattctagcgatgggccttctctttgtcctgaccacagcctgtagtgtttccggcagtggtaccttattcgatggcaaagatagtaacaaatggaaaatgacaggcgatgtctccgttcaagacgacataatgaccttgaaaggtacggatgcactggccgtactgaaaaacggcaaatacaaaaacttcgatctgacccttgatttacgtactaccccgggaggcaaaggcgccgtctggttccatacggacccaaccttgaagaaaggatatcgtatcgctatcaataatgaccgggctgataaggtttggtggaaaatgacaggaagtcttgtttccgtgaggaatttgaccaaaagcttcgtaaaagaggatcaatggttcaagatggatatccgggttgccggacaagagatcgatgtaaatataaacggcgaaccggttgtagagtatatccaaccaaccgcaccgtatcgtacggacgctaacgcctatgccttattatcggaagggacatttgccatagagagtgatggtagcggtgagatccagatcaagaacatcaccgtgaacgtaattgatgaatccacgatcgatatcaacgcacaattggcggaagctaacgatgagcaaaatgatgagatcattaaattacatcaatcggatttcccggtattagattatcacgtgcacttaaaaggtggcttaaccaaggaagttgccgctaagcaatcccgcaagaccggtatcaattatacgatcgcaccgaactgcggcatcggtttcccgatcacgaacgaccaacaagtcatggattacctaaatgagatgcgctcacagcctttcatccttggcatgcaagcggaaggacgcgaatggataaccacattctctcccgagactcttaaagaattcgactatgtgtttacggacgctttgacgttcaaggacaataaaggtcgccgtacccgcctatggattccggaagagacttggatcgagaatgaggagcaatatatggacatgatcgtagatcgtatctgctccgtattggaagagccggtagatatctatgtaaatccttgtttcttgccatctccgatggataagcgttttgacgaattctggacagaggcccgcatgaaccgtttcgtcgaggcattggcaaaaagcggaaaagctttagagatcaacgaactatacaatattccaaataaagcgatcattatgaaggcgaaagccgccggcgttaaattcacgtttggaagtaacaacgtgacaccaaacgtcagcgatctgtcttacagtatccgcatgatgaaagaatgtggcctgaccgctgaggatatgtataaaccgaaagttaaaatctaatcacacatttaccctcaccctaatcccccgtttagggacaccctaaatgagcgattagggtagacctaaacgagggattattctctttctcgcaacatccgtcgcatcttcatataccgatattgctttataatcatcttgcggctacgtatgatctgataacggtaaatgatacaagacaagatgaaatatacacctgcctgaatccataatacccggtattcatgcgccacctcatgcaaggaagcgccagccgtattgatacggataaatccctggatacccggagtagaaggaaacaaataacccaccactttccaaaacggaggaatagccgcctccggccaagagacacccgagataaataataagatgacagacgtgaaaacgaacaccaacataggcgattcgcgactcgtcataaatcccgatagcgtcatagacataaaaatacaggcaaacaggtaaggcagtaaaaacaacaaaatagtcagtggctcaccaacctgaggtaaggagaataacttagggacaatagccaatacccagatgcaaaccaccacatacagcaaaagataagtcagcgacttgccgaacacgatacgcaaagtcccgttaaaatgcctgcaaataggtaccagactatggaaacgattcttttcccgtgccgttcctcccaacattccgatgcccaatatcaaggtctgttgcaataccaagatcaagatagccggtaccaaaaaactggcaaaaccattctgggaattaaacaacgctaccgattcatacgggatcgggtctaccgtgatctggtccatcttatccgtagacgacggattattatgcatccgaagttccttacccatatccaacgatacctctgtcgccgccaaaaggaaagccttataaaacaataaggcgctcatatcgcaatacaacgagacggttgtctgtcgcccttcatgcaggtccttactataatccgggggaaagagcaaaattccataggccttcttctcatctaacatcttcttggcttccgccatatccggacaaacacccactacttccacatccggcgtggcgttaacccgtctggtaaactcacgactcaaataggaatcactttggtctaccaccaccatcttcgcttcgtgtactacctcgttattatatataaatgaataaagcagcggatatacgaaaggcaccaagaaaaagaagatcatgacccccgcatccttaaacacgtttctcaattcatctttccaaatataaagcgtatccagaagaccttcctttatgatatatcgtaaacgatgttctcttttcatcacatacagtttttacggtagatatttgaaatccaacaacgctctcttcaagttccgcccgataaggaagggcaggatcaagaatcccaacaaccaagcgtactcgcccaacgtatagaatagcgcccgcccgttcaaggcttgatcgacataaatcaagaaataatgccgcaaagggaacaaacgagccaacgcttgcaacgtagggtccataccttgtactggaaacgagaatccgacaatggagaacgagatcattccgaacaggctggcgaagctaagccctaaacggggagtcggtaatacgccgatcataaatacgcctaccgcctgagaggatataatcagcaaaaacatcgccaaaagcatcggaaaccaaccgctatttaacgggaaagaattaattccatacaacaccgcacaatacataaagcctacgaccgtaaaaatagctgtctgcggcaataactttcccaacaaactaactgcgatggaattccctcccatatccaaccatttacgggacgtggaatatttaatttccgtaccgatactgaatactgtcaccagaaataccatcaactgaatgatacccggcaaaaccgtattattcaaatataccgaataattcaaccacggattgccgatcgggtgcgtatcgatcacgatcggttgtagctgtcccatgatctgcgcttcggtatatcctttagcttgtccggtctgtaaacccacagcggcccccgccaataccgacatcgttttcatatcccgaaacagcaaagaagcggcgatcaaataggtaccattcgtatagaaagacaaccggggctgctttccagatgtggcgtccacggcgaaaccggatggaatgtaaaaaattccatatacattccctttctgcatttcctgacgagcctcggtaaacgacatggttttcatatacacctctgtctgctcaaaggcatccaactggcgaatcaaattgcgtgaagtagcagagttatccatatccaccactgctatcggcagatcggtcggcaatccctcatgcatcaacgatacaaagaaaatgacacagatagccggagcgatcaacatacaaaagaagtaaatcggttgagccaccagccgatgcacctcacgcttcgcgataagccagattctatgcaaactttctttataggtcatacgatctctttcccttttttctttaagatcacggacattcccggacgaagatcagcgactttctccaacggacgggcacgcacctcgaaagtcttcgagtcatattgtccattcgtctttgtcgctttccatgcggcatacgagcccatatccttcatataatagactttcaacttcaccggtaggtcccccaacgccggaataaaagcatttacttccgagccaatcttgatatctttcaacagatcctcacgaatactgaaagttacccatacatcatttaaatcagagatattcatgatcggagcgcctgtaccaaccaactcgccgacttccgggaaccgttctgaaacctccccgtcaatcggagccaccaaagcgctctcgcccacatacgactccacttcggcgatagcaccttccgcacgttggaccatagcggcagcggcagccttatcttccttacgggcaccttcttttgccatctcatattgagaacgggcagccttctctgtcgctaccatagcgttataattagcctccacctcgtctcttttttgagcggacatcacccctttctcgtataaattctgaatacgatcgaaagatttcttagcgatagttaatccggcttgcgccttttgccacatctcataagcggccgtaatttcctgttcacgggctcctttaatcgctttagcgttctgcgcctccgctgccgcacgagccgcctccgcttgtttcagcttcgccataacctcgggcgtatctaaaaagaccaaagtatctccggcttttacctgatcgccttcgccaaaacgataagaagcgatacgtccgggaaccttaccggagatacgaacttgggtggcctcggcctgccccattataatatcgtcaggcggtgtaagcaggaagaaacccgccaaggctaccaatccgatcacgaccaatactgtgataaaagctaacatcatgttactgatagaaaacttcttgttctcgttcatctctgtgtatatttttatttgttattactcttattcatttgcggacagtttacccaaagccttgcttagataaacttctgttaatttcacctcgatttgagcatcaatcaaactagagcgagcagaaacccatgctgtctgcgcctccattaagttcaaagccgggataaccccttcctcaaaaccgaaattcgcacgccgcaaattctcttccgcattttccatattacgggaagaagcgatcaactttttgcccgcttcattcactttataaacggattgatttacctgcaactcaatcttttcacgagcatcctgccattccagtgtttttatgcgcgtttccgctttcgccgagttacgcctataagtgccttcccaccaaccggacaagggtacctttaccataactccgacattaaacataccagcgaaatcatttttaaaaccattaaaaacattcggattcgtgacgaagtaattcgccgctaaagcgacattaggcaacatctctgccaaagcaatacgttcttttcgcttatagattttcgttgccagatccaaacttctcagttcattacgattcatgaaagcctcattcagatcagccgaggcttgtgttgtctctaccggaaaattatccagcttctcgtctgcaagcgataaatcctcctctaaagacagaccacaaatttgcgctaaaagcattcgggttaaagccagaccattctcaaccttagtctgagccatctccgcctcattcagtttcaccttgacagaaagcccatcggcctcggtagcgactccctcatagatcatagcggtcacatcactatccatcttacggagcaaatccacataagcgtccgccaatttcttcttattcaccaaagatatgacctgccaataggtttcgtcagtcttataaatcaagtcctgcaactgtaaattattcattgactccgctaattgcttggcaaacttagtgatttggttataattaacgatcttcccacccatgaatacaggctgcaccaacgatacattacccacccagatattctgcacatccaaatgttgcatatcgttcaccccactcatcaaatgttggatcatcggtaattgggccaagccacctaaagaagagctcaaggatgaggacaaagcgcccatgtccagtaagtttatatccttctggttccacatataggcaccgtttgccgataattgaggaaaatacttggtaaaagcggctttcttctcgttatccgccatcttgatcttttcgccagagatttgtagctccttattgttctggatcgccagattccggcactcttccaatgtcaacattcgctgagcgtgcatacagctcaccgtgactacaaatgttaatagtaagatagttcgtttcatctttatatcgttttaacctacctatataatgccatcatattccctatgtgacaaaaatataaaaacccgcacaaaagtataggtttaaagcgaatataaaattgaactaattcaataaaggatacgtttcttcaacttacaataccaagaatcactaacccccatatattgagctatatatttatcagggacccggcttacgatccattggtggttcgtataaagatatttcaggaattcttccgccttacaggtttgacggacagcgaacattgaatagagcttggaaataatcatcagcatcacattctgataacaggtagcgaaagctggatatcccaacgacaaacgttcgatatccgtccgggaaaaacagagcaattcaccatcctcgatagctttcacctcaaactcggaagggacttgtgtaaaataacctattgtagaaacaaaagggtacatactatccgaggagaaaccggttacgcattcattcccattctcattaatatattgattgataaaaagccctttattaataaaataggcatcttggcacaactcgcccgtacgaatcaaataatcccctttccggattgtcacacctcgagtacaactttccaaatcctttaggaaagattcatctcgagacagaatctccggaataaaacttaggaacttctcaaagtcgggagataatttcatagttaatcatccaaggtaaatctcttctgtccgatcaaattaccgtcagagaaaatatccacacggtaagtacccggagataagaattcctcgatattccaatacatggtcactgccacctcctcaccttcatattctatcattttcttcatagaataattgatttcctttccttcaaaagcgaatacatccgcacggcttttcaccaatatatcgtcatccggtttcatgatccgtacatataccatcttttcgccgacaggagcggtaatgttcttcgctatcttgaaagtcacgacgaattgctgcatcttcttaatacgcttagcgagtttacctcgagagttcacaggagtcacgttaatatccgtcgcatccaaacgactagctaacgttactctttccgtcaatttctctttttcctttttcaaggtagcagcttgtgaagtagccctctgatatttctgaacagcctctttcttttcaaccttcaattgctcattctcacgattcaaggaatcgatttggacaacatagttacgcatgattttacgtaaggtatccaattcctttttcaagcgagctatttccttcgcattcgtagccttcaccgtacgcaattcttccaataaacgttgtacctttgcttgctccgtagataatagggcaacaagggaatcattgcctacgctaaacttataaccttcatattgaagagacaattcattatattcatcctccaaagattctttctcaagatcaaaggtttccaccaaatcagtcatttgctgcttttgatgataaatataataaccggcaccagcaataatcagtaccaatactataactgctacgataagtagcgaaagtttatttacttctttattctctttcttttcagtatccatatgaggttcttagctattacaaaagcacaaaattacaatttcttatccatccgaacaacaaagtacacctaaaaatagaaaaaggcagagaggatatataccaaaaaaaggagtcaccccttacggactgactcctctccatcggctttcgcctttctcaagacggcggctacctactcttccactgttacgcagtaccatcggcgtgacgaggcttaacttctctgttcggaatgggaagaggtggatccctcgtgctatagccaccttaatatcattatcaagattttgaccggacatcaatccgaagagaccagcttcgccttatcgtcttaaaatatatcaaccctcacgtgaggaaagtcccgggccattagtaccactcggctcggacgtcgccgcccttacacctgtggcctatcaaggtcatcgtctataaccacccttgagggagatctaatcttgaggccggcttcgtacttagatgctttcagcacttatccgatccgtacttagatacccggcggtgcccctggcgggacaaccggtaaaccagtggtacgtccgacacggtcctctcgtactagtgtcagagcctcgcaaatctcctgcgcccacgatagatagagaccgaactgtctcacgacgttctgaacccagctcgcgtgccactttaatgggcgaacagcccaacccttgggaccttctccagccccaggatgtgacgagccgacatcgaggtgccaaaccattccgtcgatatgagctcttgggaatgatcagcctgttatccccggagtaccttttatcctttgagcgatggcccttccatgcggaaccaccggatcactatgctctagtttcctacctgatcgacttgtatgtctcccagtcaagcgcccttatgccattacactctgcgaccggttaccaatcggtctgagggcacctttagaagcctccgttacgcttttggaggcgaccaccccagtcaaactacccaccatacagtgtcctcctaactaggagttagaactcaaacaaccgaagggccgtatttcaacgtcggctccacaaatactggcgtacctgcttcaatgcctccggcctatcctacacatcgtctgcccaaactcaatgtaaagctatagtaaaggttcacggggtcttttcgtcccatcgcgggtaatcggcatcttcaccgatactacaatttcaccgagctcacggttgagacagtgtccagatcattacaccattcgtgcaggtcggaacttacccgacaaggaatttcgctaccttaggaccgttatagttacggccgccgtttaccggggcttcaattcaacgcttctcctcgcggatgacatctcctcttaaccttccggcaccgggcaggtgtcaggctgtatacatcatgtttccatttagcacagccatgtgtttttgttaaacagttgcctggacctattctctgcgcctcgccttacgacgaggaccctttatcccgaagttacagggtcaatttgcctagttccttaaccgtgaatcactcgagcgcctcagtattctcaacccgaccacgtgtgtccgtttacggtacgggtgccgcatggataagtttagcggattttctcgggagcatggttacgtccatattacgtcgcgcaagcgctccgtatactctcaggttcgactctccccgcggatttgcctacgggaatcaatatctacacccttcaaccggctattccgtcagccggcaggactgtcacttctccgtctccacgtcactccatgaggcagtatgggaatattaacccattcttccatcggcggcgccgttcggctttgccttaggtcccgactcaccctgatccgattagcgttgatcaggaaaccttggtctttcggcggggggtttctcgccccccttatcgttactcatacctacatttgcttttccatgcgctccaacaagggtcatccctcatcttcgacgcggcatggaatgctcccctaccatgtcttgcgacatccacggcttcggcagatcgtttatgcccgattattatccacgccagatcgctcgactagtgagctgttacgcactctttaaatgaatggctgcttccaagccaacatcctagctgtctctgcgatccgacctcgttagttcaacttaacgatcatttgggggccttagccggtggtctggattcttctcctctcggacacggaccttagcacccgcgccctcactccctgtaaatatatatcgcgcattcggagtttatctggacttgataggcggtgaagccctcgcatccaatcagtcgctctacctcacgatatactataaagaggctgcacctaaatgcatttcggggagtacgagctatctccgagtttgattagcctttcacccctaccctcagctcattggaaagcttttcaacgcttacccatccggtcctccagttggtgttacccaaccttcaacctggccaagggtagatcactcggtttcgcgtctaccccccccgacttggcgccctgttcagactcgctttcgcttcggctccgttcctcaagaacttaaccttgccggggaaggtaactcgtaggttcattatgcaaaaggcacgccgtcacgtcattacgacgctccgaccgcttgtaggcagacgggttcagggtctatttcactcccctgctcggggttcttttcacctttccctcacggtactggttcgctatcggtctctcgggagtatttagccttacgggatgggccccgctgtttcacgcaagatttctcgtgccccgcgctactcaggatgccactaggcttcgtaagggagtcatgtaccgggctttcaccgtctatggccgacttttccaagtcgttccatttcccttccttcttgccacgtcgtggtcctacaacccccgtgtcgcctagacgacatgggtttgggctcttccgtgttcgctcgccactacttacggaatcattgtttattttctcctcctatgggtacttagatgtttcagttccccacgttcgcctccctttcgggatgacaggccttcagcctgccgggttgccccattcggatatcccgggatcaacggctatttgcgcctcccccgagcttttcgcagcttatcacgtccttcgtcgcctccgagagccaaggcatccaccgtctgcccttgcttactttctctcacctcgtacttgacgtacgggttgatatatcttaagctcgctctacttgtttcttctttttgatgtccaatatgtcaaagatcctctttccctcgcgggatgtgtggagaataacggattcgaaccgttgaccctctgcgtgcaaagcagatgctctagccagctgagctaatccccctcattcggagtagtcccaggcagagttgaactgccgacctctacattatcagtgtagcgctctaaccaactgagctataggactgtcaactttgccaagacttacgtcccagcgtcatctttttctctccgaccggcctcccggtctgtacgatctatatataaacataatctcaacagcagcacaaggcgatcaatacctcgtatgacctcggtacggaatcctgaagctccagaaaggaggtgttccagccgcaccttccggtacggctaccttgttacgacttagccccagtcaccagttttaccctaggccgatcctcgcagttacggacttcaggtacccccggctcccatggcttgacgggcggtgtgtacaaggcccgggaacgtattcaccgcgccatggctgatgcgcgattactagcgaatccagcttcacggagtcgggttgcagactccgatccgaactgagacgtggtttggggattcgctccctgtcgccaggtggcttccctttgtccacgccattgtaacacgtgtgtcgccccggatgtaagggccgtgctgatttgacgtcatccccgccttcctcgcagcttacgctggcagtcccaccagagtcctcagctttacctgttagtaactagtggcaagggttgcgctcgttatggcacttaagccgacacctcacggcacgagctgacgacaaccatgcagcacctcgcaaacggctattgctagaaaaggtgtttccacctcggtccgaatgcgttcaaacccgggtaaggttcctcgcgtatcatcgaattaaaccacatgttcctccgcttgtgcgggcccccgtcaattcctttgagtttcaccgttgccggcgtactccccaggtggatcacttaacgctttcgctgtgccgcttacaatgtatcgcaaacagctagtgatcatcgtttactgcgtggactaccagggtatctaatcctgtttgatccccacgctttcgtgcatcagcgtcagtcatggcttggcaggctgccttcgcaatcggggttctgcgtgatatctaagcatttcaccgctacaccacgcattccgcctgcctcaaacatactcaagcctcccagtttcaacggcaattctatggttgagccacagactttcaccgctgacttaaaaggccgcctacgcaccctttaaacccaataaatccggataacgctcggatcctccgtattaccgcggctgctggcacggagttagccgatccttattcataaggtacatacaaaacgggacacgtcccgcactttattcccttataaaagaggtttacgatccatagaaccttcatccctcacgcgacttggctggttcaggctcgcgcccattgaccaatattcctcactgctgcctcccgtaggagtttggtccgtgtctcagtaccaatgtgggggaccttcctctcagaacccctatccatcgtcggtttggtgggccgttaccccgccaactgcctaatggaacgcatgcctatctatcagcgatgaatctttagcaaatattcccatgcgggatccctgcttcatgcggtattagtccgactttcgccgggttatccccctctgataggcaagttgcatacgcgttactcacccgtgcgccggtcgccggcgggtatcgctacccccgctgcccctcgacttgcatgtgttaagcctgtcgctagcgttcatcctgagccaggatcaaactcttcgttgtttaaattgttttatcatatcctcgctccggaatccgtttatcgtagtccaaagtcatacctcttcttgacggtatcaatccggaaaattaattttcctaatacttgtactacttgttgaattatgtaaatctctcaaagaactctctcgctatcgtttctcgattgcggctgcaaaggtaaggacttttttttaatctccaaatttttcggtgaaaaattctcgatttattttctctcgtcgatctccgggcggttggaaattatcgcttggcccagccaacctcatcccctacccaaggatacctccacgtttccatcatttctgaagcgccgttctctctcgaatgcgggtgcaaaagtaatgctataaaacatacgatccaaatttatcgggcattattttttaggctttttttcaagacttaacaagttatataatgtacgtacgataaaacacaatatatagtatccttttttccaaaatccactcataccccctcctatttaaataaaatctgttttctgtttaccccatgtttttttaatgaaagatgtatgaatcccttcgtacgataaaggatcgcctgatcaaaattcaagcagcttgccaccaagtcctccaatagtcggttgcgatccaccgtgtaaatgtctaccgcctctcccttcatatgttgcgagctaggggcacctcccactaatcggtttaactcttcgcttcgatagccactcatgatatacataggctgtcgatgatatatacgcaaaggttccaacaaccgcaccgttagattccgtatcgccggtattacctccgaaggcaacgcattattaagtccaagttccaccgccatcgcactataaacaaactcgtccatacgaaaatgctctgtcaatctcttctcatccttttccatcttaactcaaattttcaatccttaattttcaatttataagagtagtccaccccaaacagcgcgccggcaaacgtgcagatctccccaaatgcgaccagtacgctgttatctatctcaccggaaggagccacccaaaaaccacagaacactaaggtaaggccggccacgcaaagtagcacggccattaccagttgcacgttaaatctcactcgggctatcactatcagagccaccagcctccgcagtggtaccatcttgggagatccgtgagtactccagtgtcttcttcgtatccttcaactcacctcccggagtgaaaatgatacgcggcgggcgcagcatactcgaattgaaatcctttttatctgttacaccatcactgctcaccgagatccgaaaactcccgaaatcgccgagccttacgatacgcccctcctgaagctccatatccaacacgaaattaaggttatccaataccgccttcacatctgccgacgacaccgtactacgtgccgagatcaacttacatagcgttttcatactagaggtaccattcgttttcgacaccgcataaaactttttctctgaatccttctcgcccggcttcgacggacgcaacaccaacttaaaaccttgtgccatatcttttaatttttatggttatataccccttatggagcacgacacaaaggtaagatggcccagaagagacgaacgttcgtagttttatccatcaaacaagtaatattcaactaattaaaaataaaaaaccaaaaatacctcttttcaaagacaataaaaacctgctattcttaactaacattcaaatccatatctcttttaaaactcatccgtcacctccctctttccagcgagcaccaagactgcttccgcagaatgccccgcctctcgcaaatgagaagccaagccacgcaccgagcccggataatcaaaccccatcaacaggcaagaggctatttccaaggaggaaggggaagtctcacgatccgtaaactccacaagcttcactagctccaacaagagttccggacgaaatggggaatacaacaaatcaccacgcaccgtatacttacgtatataacaccgttcgcactcccggtcatgctccatatacttccggataaatttacggtacgccccgggcatcttcctataataatctccatatcccaaactacacacatccattttccaagactcccgctcatccggccccaacgttaccaagaacgcgtcaaaattcttcaccgtgggcttatgccccaatctctctctcaaacgctcatagatctttttcatcatgcgaacgcagggggaatgtttatccctgcgccgcatatggccggacaccgtacttacatacggattttcaaatacatatataaaaacagaaccggccttctaaatccctttacgggaaaagaagaccggtacaaaaccttgaccttatatcgattctacaaaatctctatcatcctatcttttcatcacaaaacccacatggttccttctcttttcttgcaaatgcctctggggaggctcttcttttttgacgctatatttaaatcaacattaatagcataggccctcacggataaatccataaaagcctcaaagacatcgaagacgattaaacaactgaatatcatttatataatactattattttaagcgcaatttactttttatttcgctctattcatccaacacctcatatttagaatgctggctcttgaactcaggaacgatctccttcatccgcttcacgatccgcatatccccctccacggcacaagcatgtaccaaggcatcaatccgcagattggcgtcagcatagtcatacgcacggacttgggcgatcttgatcttcggatgaaaagtaggcttggaggtctcctcctcattgagtacctcctcatacaacttctccccgtctcgcaatcccgtgaaccggatctcgattcccttcaccccgctcagacgaatcatccgctcagccagatccacggtccgtacaggtttacccatatcgaacacgaagatctctcccccattacccatcgtaccggcctctaggaccagcttacaagcctccggtatcagcatgaagaaacgaatgatatccttgtgcgtcaccgtcaccggaccgccccgcttgatctgctccttgaataacgggatcacggaaccgttcgatcccagcacattgccgaaacgagtcgtcacgaattgcgtgcgaccgctcaccttcccatccttgatggcttgatccaagctctgcacgtagatctcgcaaatacgtttcgagcagcccatcacgttcgtgggattcaccgctttgtcggtcgataccataacgaacttcctcgtgccgtatttcaccgccaagtctgcgatcacccgggtaccgtccacgttgttgcggacactctcctccggattatcctccatcataggcacatgcttgtaagccgcggcatgaaacacgtaatccggacgatgctcctcgaacagctcctccatgcgttcacgcacacaaatatcgctcacaaccgtctctaatagtatccaatgaaaactcctgcatgtcaaacctaaaagcagaaaaataactaatcacaacatatataaacaaactaaacacacataacgaaaatatatatttaaatttaagtttaattccagttatcataaaaacaaaaaacacagcaaacaatagaactaaaaagttcgttctacctccacctataagagcataatcctatatatatatattataatcatccgattatacactcgcttaaaaaacaaacaataagctaatatagcatttgagcaataaaacaatggaggagcaaagaatgtataaaaaacaaaatctatgctataaagatcatcatttagtatttcaaaagcatcaactcctacaagattcatagataatactacattccaatattttacgaggagacttcctaataaaatgatagacacaaaaagtattattaaatattttttactataaataaaccgattcaaagaacgagaatataaatatacctttttgtctaaacatatatttttattaacttttacagaagaaaaacctaatataatagcagaaacatttagtaacatgattacatatacttcatcagataccggataaagtccataaggattgaaagtagatataaccaaagatataaaccatatagtccaaaaagacaatatgacctttttcgaaaagctatcccttatcattctttttatatacacataaaaaaagagaaaaaacgctataatgaaaaacaacatattcttaataaatctctgttataacactttatttagatatatatcctaaataagtattactattttattaaaccctacaaccctaatcgccagttcctataaactaacgacacaaagcaaaacacttccacccctacggccattaccgtaaccgtatacatagttatgcttcctgtcagccacaacaagcccatagccgtcagaaaaaacagacaatttccaaccatcactctcatatacacggacgaatagcctagcgggaccagacgatttcctccaaggaaaccattgatagatgtcaagatcgcagagattcccagcaatcgcataatgacagaagcctcttctatgtgttctccggcgagaagatacaccaaccagtcactaccgaagaacatactaatgtagaaaagtaaagcgatccctatcgacaagaacatcacatgattgataaaacgaatattctgttcacgggaaatcttcgggaaaacggcttgcgctatcatggaggctgggagtttcatcaaaagaagcaccttatccgccatatcataaatggaaacctccaacatccccagaaaagaaccgatcaccaatttattaacgttcacataaatctgtgtggacaggatcgaaacaaataagggcaagctctccttataggccgatcgcaattcccttaccggcatcaaggaaaaccttactctctcttttcccaacacgatatataaagagagacaacccgccagtatagccccgatcccgtttaacaaggggaccagcaaataatcctcttgccgatggacaaacaagaatatagcaaccacgaacaacaggcgggcagataggttcacgaatgtgatatatttcattttctcaatcccctgaaagaaccagataggtaacagaagctcgttgaatgtcaaaaggaaagagaggacatacacccaataatgatcctcaaagaacggaaccatactgatgaccgataaatacaggactaggcaaacaagccataaaatgaacttacaccaataaatggatgtgacgatccgggataatcttgccctatcctgcttgtaaatcgccacgttcctcgctccggacatattgaacccgaagttgatcaccagcgatacatagtttattatagattgagcgaatatgatcacgccatacaattccaagcctataacccgaagcaagtaaggataggtaagcaatggaaatagaatagcgaatacctgcagcaaactcagataggaaaaattagccagtatggtcttattccttcccagcctctcttgtaaagccatcatctaaagattcaatccctaccgaagatatccctcgtatagacctttcccaacacatcgtccagacaatcatcataacgattggctatgatggcgtggctcatctccttgaaacgggcgagatcattcaccacggcactgccgaagaaagaactcccgtctttcaatgcaggctcatagacgatcaccttgacccctttcgccttgatacgtttcatcacgccttgaatagaggactggcgaaaattatcactgttcgatttcatcgtcaaacggtatacccccacgacgcattctcgctcttcggagcaccggaaaatgttcctctcgctataatcgtagtagccggccttgcgcaacacctggtccgcaatgaaatccttacgggtatgattgctctccacgatcgcggtcatcatattctggggaacatcctgataattggcgagcaactgcttggtgtccttcggcagacagtagcccccgtaaccaaagctagggttgttataatgcgtgccaatacgaggatccagccccacgccctggatgatggcactcgaatccaaacctttcacctccgcataggtatccaactcgttaaaataacttacacgcaaagccagataggtattagcaaacaacttcacggcctcggcctccttcattcccatgaatagcgccggaatatcctgtttaatggcaccttcttgaagcagggcggcgaacgtgtgggcagccttctccaaacccggaatatccgcaatcctctcgatcgcctcattctccgcattgaattgctcatcgcttagcaatttgggataaccaacgattatacggctgggataaagattgtcataaagcgccttgctctcacgcaaaaactccggagaaaacagcagattgagtcgctcaatacccttttgggcgtatctcagataaagactccggcaatatccgaccggaatggtcgacttgatcaccatcaccgcccttggattaacactcaataccagatcgatcacatcctcaatatggtgcgtatcaaaatagttcttcaccggatcataattggtaggagccgcaataacgatgaaatcggcatcacgataagcggacgctccatcaagcgtagccgtcaagttcaactccttctcctttaggtatttttcgatatactcatcctgaataggagattgcttccggtttagcgtctccaccttctccggtataacgtcaaccgcagtgaccggatgatgctgtgccaacagcgtagcaatactcaacccgacataaccggttccagctacagcaattttgatttcctctgacataatgattattgtatataagtagtcacttcagatccgtaacagacccaaagcatttgttttgactaaaaaaatatcctaggttcatccaccatgtatcttaggtgcgttggtaaaatatcttaggttagtggcgcaagtcacctaagattgctcatgggggtctatcgccccattgcccatctcatcggacggcatttccttatgagtgcctttcagatggaaatcaagatcaccttacgtaaggtctcttttatcgaatttagcacgtccgctttcattaatttatgacaattatttttcctctagagtaaatatacgaaatttcatgctaattgccaaccatcaatcaaaatcattataccataattgagtttattacttttccagcgcttcatatttggagttcatgtcagctggggcaagccttccacctcgccagcgtgccatacatggtaatccgccatgggaagcccggggacggtcaatagcttgtaatccgtctcgtccctcctcaagatatgtttacgggcgtacaaacggagtgagcgatccgtaacggacaccatcacgatcgggaacggataagcgaacaggcgcagcggcgtagtctcgctatccggaaacacacgacgcaactgataggcagaacgctcgaacgacacccagtaagatcccgtacaatacaggtgtattgagttcaggttcgcacgctcacgatccatgatctctgtcaaatggtcacgcaacaggttcatcaaacggatgcccgaaggaagggaagacatgtcttgaattatgatgtatgatgtatgaattttgaattattccttattcattatgtttcagccaaccgtcgtaatcacgtagacgacgtatcaacacagacttacttttcttgggagaaggctcgtccagccacgggtcaaccacctcgtgcgccatgcgctggtagaggctgctgtccgtacagccgtacagcgtgaccagcaacaaggcacgggattgccccgcttttatcaccgggagcatgctgcgcatcgtggcgtgcaaacgatcgaactcatccgactcgcccaaaagcagataggctggaaggagcaaagagtaaagcttgcaacggatcacgtcggtctcaccacggagagaggcgtagccacgcaggacctcacgggccagacggacatcctcatccactaccacgccggaggcatggtaacggcccaaggcatcgtgcaagccctccgacagacggtcgttgtccaaatgggtatacacgtgcttgccccccgtgttcagctcgatcaactcatactcccccgctctcacctcgaacaaggggacccacagacagtcgaggatacgcaccatcacgtccttatgcccaccgcccggctgcaccaccacctccgcctccatgtcggtaaaagggccggaggtgatacgcacacggtcgcctttcaacaagcggccgctatctggcacgtacaccggaagctcgttggagtaagaagccgcgacccaacgcaaggtatccatctcacgatccgagaggtacgggaaataagaccgcccgccggaggaaacccgggggaggaaattatacaggggaagcgtacgcttcaggcggaagatctcgtcctccgaggcgtggacgaacacgtagttgtacagcaggggccgtttcgtgttgaccatcttgccgcccaccttcctcgcctcgacatacgagggggagaaatactcgaacaaggcctccccacgacgctcacggcgggaaagctcagcgtccagccccttcgaggggctgatcctgtcacgcccgccaccggcggtagggagcgtgagcacgtaccagcggacggcctcctggtcacgtcgcttcagaacatgcgccatgaacctatccgagcacttgcctgtcaatatatccatctctatgattatcttttctagtggttatcccgtggcccgaaaacagaccccacggcaattcagagccctaccaagaatcatttacatcatcttgataaacagcgttttatatttttaaatatggcattactgaaaattaccatctctcgaaatcttaggctacttggggagtagcgtaaaaggtgcgagaacggttatcacccggttgtagagacggggcgtgtcccgtctcccactgtctgatagtagctttaagttaccatttggaggggatgagacggggcacgccccgtctctacaggaatgtatgttcgatttttagaagggacgtgatgatgtaggaaatacgagatcatttcgtctctattgccatgtctatacactaggaataagaacgaagatttaaggagaatcaaggccggagcacaaactaaaactaatgattgcttgttatttgctattttttgctacatttgcaccgtgaaatgaacgctactccccaagtagcctcatcccacctctggcatataattatatacattctcaaagcaagacttgtttaccaccgtcattttctccaacgagaaacttctcagataaatctgggttgtcttgatggatttatggcctaataactcgctgatcatctctatggggacattttgttccttcaatgccatggcaaaggaatgacggatcgtgtaagaagtcacatccgagactattccggcaacctctttcaacgtcttcaagttccggttaaaccgggacaaggccgcattgtactcgagatattcctcatggccgttcttcgtcccacttaaaaagggaaataaatagccggagcctcccgccctctcacctgccagttccttatacatagcttccgccgtatccaagacctccaaccgcatagaggtcccggtcttctggcgattgtaatccaatatgccgttcttgatattacctctattcaaatgggcgaaatcaacgaacgacattcccccatattgaaacatcaaacaaagggccaactgtgtcttccttaacttctctccttttacagggacagtcatcaggcgattcaaatcacccagaggcaaggatttcttgcgctggctttccacacccgtaaaaacccccttgaataaagaggggataaacgccgcctcgccattctccaccgccttgttatagatacaacgcaaacggcggatatacgtggagaccgtattacgcatgcagcctttctccaacaaataagcctcgtaccggcgaagagtatccttatttatatatgtatatgggatacgatccgtcccgctataccgtataaaagagttcatcgcatcctgataacttttcgccgaggaataccgtccttccttttgtaacagacttatatactctcgcatcccttccaccaaatctttctcatccatatctctctattttaaattccaactgaaaacaaacacgcaaagttagacatcttgacgattactaactctcaaacaagcatttacaattaaaacatcttcatatatttttttcactgtaaagagtcatttatttcatagttatgactttttatttcatagttatgactttttatttcatagttatgactttttatttcatagttatgacttttccaaatcataactatgaaattttcaatacaaaaaaacatataaaaacgtggatctaaatctatcgtccggaaatgccacaactacgaatttctcacttcagacaggatagaaatttcaaattaaaagttaaagcacagattgtcgaaaaaataaaaatcctaaaacatgaacgttttcaaactttttagaggctctctatgtttattatgagataaaaataaaaacctatgcgatttaaactaataggcctcatctgtcttataatgcagtgtaatttatcttgcactcaacacattataaacaaagaaaccgtccagactttggatttacaccgctatatggggaaatggtttgaaatagcacgctttgatcatcgctttgagcataatctcgtaggggctaccgtggaatactcatttctcccgaatggagatatagaagttgttaacagcggatattggggtaatttttccggttccttcaaacgagcgaaaggtatagccaaaataacagatcctacgtgtcctagtaaattaaaagtgtgtttctttatgcggttctacgccgagtacaacattatggaaattgacgaggataattactcatacgctctcgtaggcagtaatacctcagactatttatggctacttagtcgtacgcctacactcccagaagaggctattctctttttattgactaaggccaaagaaagaggatataacacatcaatgctcaaatgggtcaaacaaaaacatgaaaatcaaaaataatttcttcaaatttcgctataagcattgaaaatattcaacttatggctaattttgttgttataatataaaaagcgttgttttatgaaaaaaatattacaagagtttaagcagttcgccatgcgaggtaacgtagtggacatggcggtaggtatcattatcggtggtgcctttggaaagatcgtatcttctatcgtagcggatctgatcatgccggcggtaggtttacttgtaggtggcgtcaatttcacggatttaaaaatcaccttgaagcatgctgtaatggagggagacaaggtgatctctccggcggtctccattaactacggaaatttcatacaagtgacactggatttcataatcatagctttcgccgtctttttacttgtcaaaggtgttaatgctttaagcaagaagaaggaagaggccccgaaagctccggccgctccccctgcggatatccaattacttaccgagattagggatttactgaaaaataacaaataaacaccaaccttattggttgacttgctgtttcataactacaaaaaataatgttttaactcataaaaagtagtagttatgaaaaatgtattattcggtttagccgtaggtgtagttgttggttacgtacttcgcaggatggaagatcaaggacagttcgaatgtctggagaacgaactccacggtcttacagataaggcgaagaaaaaagtaaaggacgtggtagacacgggtaaaaatcaagtcgaatacgtcaaagacagagtagaacatatggttgaaaaacctaaaagtaattaatcgacctccctgttattagggcaagaaaaagaagctatcacaaaaaaagtcaatgatagcttttttttttcattttagatgtaacgttttttcaactccattcgtcttataagaaaagagtataaattaattacacttcatatgagaacaagaatgatggccttatttgcgttgatcgctttttgcgtgatgcctatcgaggcgaagaaagtaaaagggaatggggatattatcacgaaagaaatctccgtcagagactattcagcgataaaagtcggctcaaccgccatggggtatagcgacagttggttcagcctattcagccgtgggggaaatccgtcgtacgttttcggatatacgcaaggagaatcagcgtccttacgaatcacgatcgacgagaacttatatccttatataaacgttcaagtaaaaaacgaagaactttcaatctccacagagaatggtacacaattaagccctacccgatttaaaatagagggcacttccaagaagctggaaaaaatccagatgtccggttgtatggattttgtcctgagaagcgctttatccggagatgatctggaaattatagcgacaaggggtagcgacgtgaaaatggagaaaccggtcaacgtatctaattgcataattgaggcgaccagcggtagcgatatcatcatcaacgatcttactacccgaataatacgaggccgtgccagcggaggtagcgatctcaagcttacgggaaaagcggagaacggcgaatattccgcctcaggtggctcggatatcaaggcttatgatcttatcttaaaccagttggaatgttccgccagtggtggctccgatatttatacgcacgtaaccgattatatcaaggcttcggcaagcggaggtagtgatgtacattacaaaggttcggcaagatcggatacatccacttccggaggaagcgatattataaaagagggtaattaacaccctctttttttaccctcttatacattgaattttataacaaaagtacttccttttccaactgcgctatcaacagaaagtgttcctccatgagcttccacgaagtctttactgatagccaaccctaggccactcccttgtaccttcgttcccggcacacggaaatagcgatcgaatatactttgatgatatcggggatcaatacccttaccgaaatcttgcacatagatctccacgctatgatcttgctggcgggcaccgattatgatacggccattctccggggtataatgaattgcgttcgacaatagattcgtcaagacccatgcgattttctcgctatccacgaaaagcttggaaatcttctccgggtattccacctctatatggcaattgaagcgatcagcttgcacttggttcgcctttatcgcatactcgatcaattcgatcggtttggttattttcggattcaattgtagcttgccagcctccacctgcgtcattttcaatagctcactggttatttccagtaatcgattactactttccttgatactttccgccagtgctttttgctcgtcgttcatggctcccacacgggcatcctccaacaatttcaggctcatcatgatcgccgatatcggagttttcaattcatgggagatcgtcgagataaaagtggtcttagcggaatccaactccttaaactccgtgatgttcttcaataagatcacgtcgcccacatacacctccgcctcgccattctccaacacacggatcggtatatattgcacttgaaaataactttccttattatctgcgtaaattttaagcggctcttttttctcgctcggctggatcagttcccgaactaacctgcgaagcaaatcgttccgtaaggataattccgaggcagactttccgatcacgttttcccgcttgagattcaagatcgtcaaagcctcgttattggcgaaaagaatcttacgatcccgatccaagcctatgattggctccgtgatactattcacgatagcctctatatatttctttccttggataatatccgccaacgtacttttccggtattccgtaagccgttccgccatccggttaaaggatttcgcgaccccctcgaattcatcatatttagcgagatccaagcgtttctcgtaattatggttagcgatctccatgataccgtccatcaacatacggataggggtatttatcgaacgggggaaacgtattaaaaaagcgaaagcgaccaccatacaagagaggccaatcccccaaatccaaaataaagccttttgagacgtagactccgccacttggcttttcctgtagatagaagccatattcaaactcatgacttgatttaaggcgagacgtacacgacggatattctcctcattacgctctttcgccaattgctcgtattgagcgactagatgtgaggtggccacattctcatcgacctccgtgatattctttttctgtagccctaggtttttctcgaaatctgcttgagccgaaggatcgctatcaattcgttccagcgcatccagcatccggcgtgaatagagcaaagaattataattatcggccaatatgttccttgtgtcggcagacatatcggagatgttctttaccgatagacctcccagcaaaacgatcatggcaaacagcagcccgattccgtatcttagttttgttttaatcttcagactcataggtgatgtattttaagcgattattattaagtttacgttcagcaaagataaaatatttagcaatgtccgtttctccttgcatatcttcaaaatgctttcgggtatacataaatgcagaatatgagactaaagcccatactcctcaatcttccgataaagagtagtgaggcctatacctagaaggcgggaagtttcggttttattgccttttgtgtatttgagcactttttggatatgcattttctctacgccactcaggtcaaaaccgctataagattccgtactcgccgcagaggaggtttgcatattcaaagggagggcatccaaggttaaggtatctccatcggcaataattaggctacgctcaattgcattacgcaactcacgtacgttacctttccaagctcgttttttcagggcatctatatattcgggcgaaattgttcggatattctttcccatcttggaggaaaaagcggaaacaaaggcttttatatggagagggatatcctcgacccgttcacgaagcgcaggaagatggatctggaaaacggaaagccgataaaatagatcttcccggaaatgtcctagctcgatctctttctctaagtcacgattggtagcggcaataatgcgtacatccactttcgtaggtttcgtatcgccgatcttgataaactccccggtctcaaggatacggagcaatttcgcttgcaagtcgaaagccatttccccgatctcatccaagaagatcgtacctccggaagcttcctcaaacaagccttttgtctctttcaaagcaccggtaaaagcccccgctttatgaccgaacatctcgctttccaataaatcccgactaaaagaggaacaattgatagcgacaaaagacttccctttccgggaactatgttgatggatggattgagcaaagacctcttttcccgtaccggtctcaccagtcaacagaaccggaacctccgtagccgagactttctgagccaacgctatcgccgcttggatagcgggtgatttaccgacaatcgtatcaaacgaatattgcctcccgacggacgtagcttccttcttttgctgttgataagcggcagaagctctctccatcgctttggctaccagaggaatgatcttattattatcatcccctttcgtgatataatcgaaggctccattcttgattgcctgtacgccatccggaatattaccatgcgcggtaagtaggatgatctcggatagagggcgaagtttctttaagtccgacaccaaatccacaccattaccatccggcaagaacacatcgcacaataccacctctggcgaatgttgctccatctgcctcagccccgccttacaagtagcagcctgtaagacctcgtatccctccaaaccgataatgcgtgaaagtaaacctaaaatctgcttctcgtcgtcgataattaaaactttgcccatacaccggagttatttatttgggcacaaatgtacgctttttacctttttcccaaaagcattaaagcatacatgttaacgccgtcttatttaaaatcgtcacctttctccttgtaatgctgataaatccctcatccaccaatctcccgatttccttcgataaagccgggcgggtaacaccaaaatactccgctaactgctcttgggtatgttctagttccacgacattcgaatccttttgctgatgttcgaataagtaataaataaagcggttccggatgccacgaaacgaaagcaccttcaaacgagtcatcgtacatttattacagcttgtactgacacaaaggaaattatgcaggaataacggcatagaatgcattaaggtaaatacagactccttggaacccttaagcaataccacatcctcgtcgacggtaaaagtagcggggaattggtttttctcggaaaagatatgaggcgtagcgaacgtgcgtggagcctgtatcgtctccacgcgcacgatgttacctgatacgtccaaaacatccacgttcaattttcccttcaataagacatgaagggcgttacaagtcgtcccttgatgaattatggtttttccttttggatgctcctctactgtatattcaagtttatccaaaaactcttcccgcatcttaagcgtaaaattcttaaaaagcggaattttaaacatatcggttatatccatcgtatcttgttttgaaaaaaggtttactcctgcaaatatacccttttccttgagaactgttaccatttcgtcgtgaatatagtcggattaatatttattgataaccaaccccaatcttgccaatgagacggatttccacccttcacggccttcatggtattcgtacccaacatcgtagaatatcccgcggataatttcacgtctttcatgattacccaatccacttggaaatccaattccgaacctaaacctttactcaatttatcattaccttcgtatacgtcgcccgtgatggagaaataatgataggctaaagacaggtttaccttggaagaaggtttataggcgacatttacctgattatcccataagcccggattcaatccgttgacaaaagaggaggcgtagaaataatccatggcaccataaaacttatgatgggttccgtacagaggatcaaacgccttatatttcccgtcggccccatccgagccactcagataatcactacctacaccgatcttccattgcggatcgatttgataagcggcgtttaccgcccataaaaaagcggaaacatcccgtccgcttttcgtcttgccgaattgataatagaacataccgcctaccatccagtggctaggcgtatagatcaggttcgttcccaacgtttgcaggtattttgtatccgagttttgtttctcggcatcaccgccttccatccctaagttcataaacaagaaggatgcgttaaaactcttgtcgaagagatgcttataccaaagggtttgcattgttttatagggttgcgcgcccggagcgtaatacgttcctccgatcgttttctcatcattctggttgaacgcaagaattaaatgcagttggttattcgtgttctcatagcccagtttcaaagcgtcgtgataacgaccggccacgttccaatccaacgcacccatgatacgctcgtcatcgtataccaacgactggcgacctaacttagcgaagaaacccgatccgaaatccagtttcgcccacgcctcattcaagataaaacgaccattcttatcgatttgaggatcctgcccccatacgccaacatgttgcgcggacaaaccgatagacaaacgatcccgctcataccccaaagaaaagcgggcacggttattgataaacccggtggactcggcatctttaggccgggggaataagaccccgttccggtactcggctctcggacgtatctgcactttcatcgaaaacgtattctctttcgtattttgtgtttcttccgcttgcgcgaaaagggccacagagagcaagcccgctactaaaacaactagttttttcatatacctctgattttaattattccatattataagtatgtacactatatcctcgtgcggagggtagataattcacgccaatccaacacacctgtagcaaaagaaaagagaaaaccaaaagccccaacgccgccgaataacgcaagtgatgacgaaggcgataatggatataaatcaagtaccccaaccaagtggcagccgcccatgtctccttcgggtcccaattccaataatgcccccacgcctccttggcccataaagcgccgaacagcatcccaatcgtgaggaaggccataccgacatataccaagttatcgcataaactcatcatcccctcgtcaatccccttcttcctcgcacggatcagcaggtaaatggcgataagggcagcggcgcccagcatggcgtaagagaacatatagactatcacgtgcggagcgaaccacgggctttgcaaagcgggcatcaaggtcttgttatgtatctccggcttaaacagattgacacagataaagacaaaggccaacaatgtactaaaggaaagtatccatttataccgccaacggacataagtgatcacgcccgccaccggcaagaagaaagaataccataaacgagtctcgcccatcgtgcgcaagggcggcctctccaacgagatccacatccctacgataaaagcggaaaatataaccaagccaaacacggtccaagcgacagcccccttggaaaaagaaggacgataagccaaccatgccccacctatccagcaaagtaacgccggagcggcgaaataaataaagtaactccaatccatactattctttttttacgggagcggacaggaataatccgatcgccccggctatcatcattaagatccctgtataaacgatcggcaaccatggatctcttaccaactcaaatacactcatccggctccatttacctttcgtctcgtcgtaactcaactggtagattttccatccggcgatagagagcggcttattcacctcgatacacgcctccttggtctgtttatctttcgtatagaccataacgtccgaggcaaagcgtctcggttcccgttccggcatcaccatgctaaccgcatcatccagctggagcgatatatatgggaagatatagctgccacaactcacccagccttccttctgccgtccggtaagttcgttacgtgcttttacgtataaagcggtggtcgccccctcggagtgaaattccacgaagtttaccgtatcctgccccatcacgcaagctgccatcggtagtgaacgggtaacctcaaccttccagccttgcaggttcccggccaagggagtttcctctaccaatagattctcgggttgtttttcgggaagcgcttttccggtcgtattgtcgatcagcattaacttaggaggatattcatcgatcgtaaacgaacgaagctcgatggcgagcggtagctctatcatctcattcttctcgtccgaagccctccactcgggattctccaacggaaccgtcatccgtaaacggcgtaaatccccgtttcccaagatcgccgccagcagcgtgataaataagccggcatggttcagcataaacggaacatcccgccagcgaaacgatacgatacgcttcaatgtgacaaagcccaagacaaacaagaaatagagaaacagcaggacaaaaggccacgacatcgtaatccgctcgatacccggacccacaaatcccataaccaacacaactgacaaaagagccgacaaagaggtaatgctcgccgttaacccggaaaaccactggacaaccgtgattttccggctaacaacaaaccctatacatagaaccagcagaaaaatcaatcctccggccacattcaccggatattggaacaaccctgcctgaaccgggccagtgatcagttgcaagccaaatcccgtaatcagtaaaccggcacagatggcccagccttcagcagatccccaaggttgtttccacataatcaaatgttcttcgctaaacgattattttcttgcgcctctttcacccattgaggaacgatcgtattcaggaatttttccttggcggtacgttcagcggccatatccaaaccgatatattgctgagccttttctttcgtagagaagtccggcatcggaacatcatccgtataacctaatttcgctaacactttcgcagtagccagacgagcctgcatcgccttatccaatccattgcctaatatcctttgaatctcttgcggagcgtggaacgcaccaccatgagaagccacgccgaaatcccaacgccattgtgcctgacggatcagtttcaatacatctttcatctgatcctcggtagcccccttatcccacgcgaacttcgcctcgatatgcgctttcgccaactcggtctccaaacggtaacgcatctcgttcgccttattctgacgctcgtacacattattgcgtaaggtctcctcgctctcacggtggcaaacctgacacgtacggtcgatcatagccaacgggctttggatatggtggtcactatatttcacgcccccctcgctcttatacggcatatggcaatcggcgcaagatacaccccgctgcgcatggatacccatttgggagatctcataatccggatgctgtgcctttaaaataggagcacggcttagcttatgcgtataatcggagaaaccggcctcatcataataagcctccatatcctcaaccgtagaacctttatcccaagggaaagtcaagtatttgccatcgcccttgaaataatattccacgtggcattgcgcgcaaaccaaggaacgcatctcttgctgggtcgctttcgtgatgtccttgccttgacgctggaaagcctcgatcaaagccgggcgactgatatgcaggttcatattctccggctcatggcaatcggcgcaaccgatcggattcataatctctttacccagagaagcccatttgcccttatagaaattatccacgcccatcgcttgcatcatgcggggaacatccgggcttttgcaagtccagcaagtagccggttgcggcccctcgttctctgtcatcggagcgcctacacgcaacgtgttacgcatatcctcgatcgcatgcatatgccctctcggggtagaataatccttagagaaagcgtaaccagcccaaaggatcaccatttccggacgagcctccagaacatcgaccgcctgatttccattgtataaactcttgaaactcgtatccgccgtagcctcccaagtctggtactcacgtggataattcgattcgaacttatcattgcgagcctcgattcctgtgatctccgtcttcttattattcattacgctagtgacctccgcatgtctctcgttcacggaagcagcgatcatacccaaaacaaaaacaacgaccatggttcctccaaacagcaaccaaccttgccatgattttaatttcttttccataactatactgatttattattatttacttagcatatcttttaaccagtccggcgatacggacttcggataaggcaccaacgcattcggtgtagaagacaggctgttcgtacctccgtgcggcacctcgcgatggcaatcccagcaagctttcccttctcccgccattgccatctcatgatcgatccttccggtattcacgaattccgtattcaattgcgtatggcaacggatacagttattcatgattacctccgcgctctcgtcgatcgcctgtatcacttgcggttcccctcgcatcatgaataccgaggcgtggcgcattccgtccatacctttgaagaaccacttcttcacggcgttctcgtgcggcacatggcagtcgttgcaagtggcgttacggctgtgcgagctatgattccatgtagcataataagggcccataatgtggcaattcacgcaagtagccgggtcgtcggacaaataagtccacgcccgggaagcatataaggtataagaccccagcccgcaaaggacacctccggctatgatagcggctagtttccaagttcttgtcgggaacagcgtttgtattatttctcttattttcataccgctgattctttaatattggtttatgagacacaaatatcctaaacttgcgtgtaggaaattgtaataaatattacattgcacgaaattttatgcgtaaaatgaaaagattgttatttatctcggtctccgcactccttttatgttcttcgtgcgtgagtaaaaagaaatacctccttgccgagaacggccggttggaggcgatcggacgtggcgacgccttgaaggaggaattgattaaatgcaaggacgataacgatgcgctcaacaaccggatcgccgccttgataagggatacgaccacaatggggcgtgatatccgtaattaccagaccatgttgaataccaatatgggtgagcaggacaagctgaatgccttgttacagcaaaagatgagtgagctggacgagcgtgagcgtaccatcaacgagctacaggatatgatgaacgcacagaacgaaaaggtacagaatttgttgagtagcgtgaaagacgctttgctgggtttcaacagtgatgagctgaccgtaaccgagaagaatggtaaagtatatgtagccatgtcggataagcttctgttccaatcgggtagcgcaagggtcgataaacgaggcaaggaagcgttggctaagttggccgaagtgttgaataagcaaaacgatatagacgtttatatagagggccatacggacagcaagccgatcaataccgcccaattcaaggataattgggatctaagcgtgatccgtgcgacctccgtagtacggatccttaccaaggattacggggtgaatccgttacagatacagccttgtggtcgtggggagtttatgccggtcgctgataacgagaccgccgatggacgtagcaagaaccgccgtacggagatcatcatggctccgaagttggataagttgatgcagatgttgcagtgataatgatattgtcaagctccgggtattatctactgccgaagcttggctagaacgttcactcttccaaatgatagacaacacaccgatacctcaattccgatggtttacaaggaatccatacatccatatcctctccattcgcggaacgaatgatatggaggagagccgtatcatacctatccgtcctttccccgacagagaccgatcccccttgagcgcacgaccggatatggaactgaacatccgcaagatcatatacctcagatctaagataaggataaaaacctattattgaactcaatgtatcctcccaaacccaaatactatttccatcatcctgatacgtatattccgtccttaccacataggacttataggtgtaagaacccgtataaccaaactcatcccctacgttataaggcaaacgtccttcactagtagccagctcatgcgcaagagtgaaccctacaatatccaaggtatcaccacttacgatctctatcgtcggttcagaatgcaaatcatccttaccaagatcttccacccgtgagcaagccacattaaggcccatcataaaagctaaacatacaacgattaaatgtctcatatcattctatattttttaattgatcaaagtttacacgaagataacgccatcgcaactcctccggccgtacaggaagccagcgatcgatcttctctccatctgagttcttctctacatatattaaataggtacatgctatcacttgcctcttatcatctcgcatatgctgtgaactgataacgaagccttgcgaactaaaatccttcaaaaaacccgctttctcttccgcatacgagttctgccctatatcataaatactatcctctaaagaaaccacccttgcctcatacgagaaatagagataagaggcattcatatcaaactcttgcgcaacatccccgggcaatgttccccatttcgcgtcatacgcctcacaagccgtgaagcccttcaccaatatggaatccatccctaagtcaccccccagatgaatcgtatccggccttgaatataaagtcatctgattagcgattttaacctcatcatccccacaagcagccagaaatagagctataaatagcccacacaaaaacaaacctttattcatatccactctcttttattttatttaaaatgaaaacgatatagataaacagatattgcttgagcgtaacatttatcccatgaaacccaagccttcatacacaagccatactggtttattatccggattccataagtaaaaaacagcattccaaatttaccgcttgcatttgatagcgaaatacaagatatacaagaaagcgatcaacgggacgatgaagcccagcgccatattctcctcgccgatatatcccatcagcatcggactgaaagcgccgccggcgactcccatcacgatataagaagaggctttcttggtataaacgcccataccttccagccccaacgcgaaaatcgtagggaacatgatggacatgaagaaaaaggataaataaagagcgtatagcgaaagcgtacctacggaagccaccaccaaagccatacaaacggcactcaacaaagaataccaagtcagcaagcggcccggagccaaccacttcatcgtaaaactaccgctcaaacgcccgatcataaacaaggccattccaccgaatgccaaaatacgagacgctcgcaaattactgatacccgggtccatctccgtcacgtaattaataaagaacccgaagattcccgtctgcgcggcgcaataacagaattgggcgaccacggaacgtacaaactgcctacgtttccatagggaggcagcgggtttctcctcgacaatagcggtcacctcctcctcttcttccggcttaatctccggcaacttcgtgaaaaagaaaagcaacgctacgaacaagacgataccacctaccaagatataaggtttagtcaacgccatcgaatctccctccggtgccccgaatatcaacaaaccacctaccaatggccccaatatccaacctaatccattaaaagactgggataagttcagccgttgggcggcggaagcgggcggccccaatatcgtagaataaggattcgccgccgtctccaagatacaaagcccgcaagcgatcacaaacaaggcgatcaagaaaggcgtagccgaatgcaaaaaagctgccgggataaacccgaaagctccgatagcgaacaatagcaaacccatgataatccctttcctatatccgtaacgtttcatgaacgctcccgccggcaacgccatcaagaaataagcgatatacgtagagaattgcaccaagccgctctctgctttggtcatcgtgaagactccttggaaatgcttgttcagcacatccaagagtccgtgggcgaatccccaaagcaagaacaaactcgtgatcaagataaatgggaccaaataagatttccctcccggggcggccaccagcgactgtttcttttgtttttccatccttccgtctatttactcgcgcccggcaatttaaacatacattccattaactgccatttctccgacgaggagcttcccggaacggctttctgatacttcgccacgaagtcctcccattccgcttgcttatccatcgtcgccaaacgggcgaacgccgcatcccaatcaaaatcatcgggcgtctccacgatcatgaacaaccgggttcccaaacggtaaatctccatattcaagatccctaccgcacggattccttccggtatctccggccagatatgttccggcgaatgccaatagcaatactcttttatcaactgctcgtcctctttcagatccaaggtctgacaatatcttttcataacattgtttttaaaatgaagtcgcgaaggtacaaaagtatccttaatccagataaacatcttcgcccggatgcttataataggcgtacatccgttggatctgctccggcagcacacgctccaaggacaacgggggcaactcctccaatcgaaagaagcctttccccaagatatcgaaggtctcggtaaacgacccgcccttcaactcgcaaaggataaaaaacttatatacataataaggtatagcgggatgcggatgcttgctcatatccatcacggccagcaagcggaccggaagcacatccaagcccgtctcctctttcacctctttcgccgctacctctttcggggaataccccacatcgctccatccgccgggcaacgaccaacatccgtccattttctcacggaccagcaaaatctcgtctttctcgttaaagacaaccgcacggatatcgactttcggggttacatactcttgggccgggcggtaaccactcgccacatcatcgggcttcaatccggtagccagagccgttatctcatcacttaggcggctcaactcttcataacgttccgtatcgtactcgcttaatgaataaaccaaccccgtctgagacaaggcccggatacgctggcccaataaaatcaattccttacttctagacataatagctttactgttttagataacatgatcccatatgattcatgaatagaacgtctaaagataaaagttattatccagtccgtcattctatcgtgccaaaataacgtatattatgccaatattacagattcccgtttcattgtatcttattccagtttctaaaagatattattccctgcacccgcatcccccgaaacataagttccccatgcgtgggttaaaccttattcaatctctttcatccgagttaacacacacattatcagattggcatgccatttgaagtatctatagcgaattcgagattaaaaaggacgagttcagaaataagaatagtaaatagaatgtttaactaataattggaggactgtattatgacaccgatgagaagaagtcaaaattggttaccgtatgtattcaatgatttatttgacaacgactggatgataaaagcaaactctacagctccagccatcaacgtgatagaatccgataaggattatcgagttgaggtagccgctcccggtatgacgaagaacgatttcaacatcaagatcgatgagaacaacaacttggtcgtatctatggagaaaaaagaagaaaagaatgaggataagaaagacggacgctatctgagacgcgaattctcttatagcaagttccaacaaaccatggttttgcctgacaatgtagagaaagacaagattgaggcgaaggttgagaacggcgtcttgagtatcagcataccgaaaagaactgaggaagaggctaaaatggccgagaaagtaatcgagatcaaataacctcgatacactttccttcgtaaaaactcaacaaaaccgataatggcttgttctatttataaacaacataaaatagaataagccattatgattttaagcagaaaattatcagatgctctaaacgagcaaatcaacatggagatgtggtcatccaacctatatttatccatgtcggtacatttcactcagataggactggatggttttgcgcattggacgttaaaacaatcgcaagaagaacttgagcacgcctataaaatgatcgattactcaatcaagcgtggcggacaagtgacgatcggagtagttaattccgttcctacagcatggggagagccgttggagattttccagcatatctacgagcatgaggtgcatgtatccggatcaatcgacaagattgtcgatatcgcttccgaagagaaagacaaggcgacacaagatttcctatggggcttcgttcgggaacaggtagaggaagaggctacagcgaaaaatattgtcgagaaacttaaattatacggagaacatcatgccgtattaatggatcatcgattaggaaaaagataaacgaatacctgcttgtcatgcctataaatgggcctaaaaagccatgtcgtcttcttgggatggcatggcttttttatagaggtcaaagccctaaagcctgacgaatcgcctcactccacaattcgcctaaccggaccgctcctttctcattcggatgaagatagaacactccggcgttacccttctccgcttggaaatctgtcaaatggttttccttaaagtaatcaaatcccttcgtatctcccagaaagacttgtccgggaaaatgagacgcataataatcgactaatcgttgtatttgcggataataatcttggagccttcgtaagccttcttccaaatatttagccccattatacgtattcgggctataccataaaggacgatgtaccacaatacggcaattcgggtataaagctaataagcgattgataattgtcttcatattctcataataccgctcgggcgctaccgggcagccgttcgtgccttctatcgcgctatcgttcgtccccagcataatagagaataccaaatccgcccaagtctcatccttaaatttatcggcagcacgtacggcccacgggaaaagcgtattcgtatccggcaaataatcaacggtagtgcatccgctctgtcctctattggtatacttgactgaagccacctccgggcacttgcttaaaaacaacgcagcctttacaggaggcgcatcatggacaggcttcggtaacccggcgccaaacgtgatactattcccgataaatacgatattcacataacgtttattgtttgcggctgaagcagaccaacacataacgatacttattaaaatacatatgactcccttaatttgtctcatggctcccattcaattgattctcctgcgaaggtaagaataatttgattatctcgggatgtttttcaagccaaacacgggctgatcgcgattccgtacgtgtcccgtcttccatataatacatcaattcgctcagttgttcatcggttaacttaaagttcttgaaaaaagaggctgcatatggatctttcttagagaatcctttcgtagcgataacctcgatatgctccgagtctccaaattcctctttcgggtcttccaagaattttaacggataacgtgagaacatccaatgaggggtccatccggtaaccacgatccattcgttcgcatcaatcgatttcttcaagaaagcaaccatcgtagccccactggaagatttcaaatcaaaatccaaagaataatcttgaaccgccttatccgccgagttcatcaaaccggcgccggcatcgatccctataatctcacctttaaactgatctttatgggcattcaaatcctcgatggaacgaatggtaacgtactccggaactaccaagcccaatttcgcatgctcataaaccgttccgagtgtctcaagccggtcaccgtattgttccatataatccgcatgggtcaccggtaaccatgcatccatgaacacatccgcttttcccgaagcgacagaagtaaagatcggggcgatatccgcattttttaatgttacccgatatccttgatcctctaatatcactttggctaagttggtcatagcaatgccctccgcccaattagcgtacgctatcgatattttctttcgatccttgctatccacacaactgaaaataaattgtaaggtcaccaaaagcatacagcatccaataataatcgtaaatcgtctcatatatctatttctttcttttctatgtttcttatttcttttgtttattcactttacctttcgcccagccctgcgtaatacgatccaagataatagccaagataacgaccgctatacctccttcgaaacctaaacctattttcatttgggtaattcctcgcaagacaatctcacccaatcctcctgccgagatcatggccgctataactaccatagaaagtgaaagcatgatcgtttgattcactcccgtcatgatcgttggcaaagccaatggcaattgcaccttatagagcaactgagtggaagtagcgccaaatgagcgggtagcctccacaatatcggccgggacttgacggattcccagatcggtcaaccgcacaaccggaggcatggcaaaaatcaccgttgcaaaggcgccgggtaccggacctaaaccaaaaaacaaaacggcaggtatcaagtagacgaaagcgggcatcgtttgcatcaaatccaagaccggatggatgatcttatccgcccggtcactacgtgcggtccaaattcctaacggaactccgatcatcaaggcgataatggtagaagacagtaccaaggccaaagtctgcatcgtttccacccagaaacccattccgtaaattaacaatagacccaatgccgtgaacacgccgactccttttcctgccttgaaccaagccaacaatgccaagcccaaaatcatcacataaaacggaatccaagtcagcccatcttgaaaagtatcgataaatcctccgaccccatcatttatcacatcaaaaaaacgagcgaaatgctcagtcagccaattaatggcaatctctatatattttcctatatttatcataattctatcgcattttgaacaatttgatctatttcctctttatccttccccgtcatctcgattataatcgatgaagtagaaaccaagccagccaattggttggcctcattaacgaccggtaaggcctgccggatctccggtaacaaaggaagcatatcctcaaccgtcgtgttttccagaaccgaaggcacctctttcatcacaatcgacgagagatcatgattccccgctttccgaagagccaagacatctttcaaacgaacctcgcccagaaattgcctattcccatccacgaccggcaatacatataagtttttctctttcattttcctcaacacggtctccgggccatctttacggatacgagcgacaaccggctgggttatcataatcgatgaggccgtaacgatacgtccacgatctacattttccgtaaatctagagacgtaatgattggccgggtctgtcaagatctcctcaggggtacctacttgcacgacctccccgtctttcataatggcgatacgatcccccaacttaatcgcctcgtcaagatcatgcgtaataaagatgatcgttttttgcatcttctcttgtagtttcaatagctcatcctgcatctgtacacggatcaatgggtctaaggcagaaaaagcctcatccatcaagagcacctcgggatcattcgcgatcgcacgggccaatccgacacgttgctgcatacctccagacaactcgctaaccttctggttctcgtatccttttaaccctactagggctacactttccacagctttctggtctctttcttttttaggaaccccttgtaactccaagccaaaagcgatattactcaataccgtgcgatggggcagcaatccaaaatgctggaaaaccatagccatttccttacgccgtatatccaataattctttatccgaggaagtcgttatgttttttccgttgataaagacttctcccaaagagggttcgttcaatcggttaatacaacgtaacagcgtagattttccacttccggaaagtcccattatcacaaataactccccttcctcaatctttaggttcgcattacgtacagctaccgtgcaacccgtttctttcaaaatgttttgtttactttttcccgctactagcattcttttcgcacgcattttctccgggccgaaaagaatagataaattctttatttctattttcgtcatataaaatccttgattacaggtatgatacaaaaagattaggccataagtccagaatttcttatggcaaaacataaaccaaaagcatgtataagttaatgcttattatggaaattgactacaacctaaatcatctcttatatagacaaccgaatttcaaagagttttgttcactagtttttccaactattgggtcttttcataggtaaagtgaaaataaatgtagaaccaaatccttcttcggaaatcactgaaatattaccgcccatttttaataccagacctttacaaattgctaatcccaatccgactccttgctcaaaatcgcttaattgcacgaatcgggcaaagatattatccaattcatccttgggaatgccacaacctgtatccgagacataaaacttaaccattttcccctcatcctcaagcgtatatccaaaccagatactacctttcttggtatgcttaaccgcattcgtcaataaattcatgcagatttgccataatcgatttcgatctatattaaatatgatatcgggacatgcatccaaggttatttccaccccttccggcttacgtaattgtatggagttatatagatctttcataaaggaaggtaaataaacatccatataagtaaatgtcatcatatcagactcgattctggaaatatccaaaacatcattgactatacttaaaagtaaatcattgttcatcttgatcaagctaatataattttgacgcaattccaaatcctcctccactcctaacaaatcagagaaaccgacaatagcgttcaatggcgtacggatctcatgggtcatatttgctaagaaagttgacttaagcatatccgcctcctccgctttttccttggcacggatcaagtcctcctcaaactccaatcgttcttgatcatcgatcatacaaccaacaatcaaattcgggaaaccattctcatctttctcatgcgtcttaccgatcacctcatagatccgataggtgttatcatcgttctttagacgaaaatctattttatattcatccaatttattcgtacggatcgtattgaatagatagaaaaagtcgccagaatcgtccgggtgacgaagttgcggcaaagcctgacagatgaactgattacgtttcaataaactattggtcgtgccataaaactggaaacaacggttacaatgtactttatcgcaagacttaaatcggctgaaattaaaagaataagtcgtaatcttgctattctgcaaagcaagctccatcatcatccgactttcggacaacttactgcttaacgcctcattcgctttctcctgctcaacgagctccgatacattccgtatataaataatcacataccggtcatgtacaggtaccaaccgtagtttaaaataaacgatcggagcgttatgtcccggaatcgataaatctaaattcatgatctccgacttattcaagcaactttgcacgatcgcagccacacgacgcttagtctcatccggataaatgaaacccggaagatcatcgatacgccgattgatcgactctggtgttatacaagtctccatagcataagcgataatcctctctacaaccagttgcttgtttaccaaaaggatcgtatcaggaaccgcttccgccatcttttgcgacatgtccgtcaattccttcaattcccggtcataaccggctgcctcctgcccgaccgccggattacccgttaataataaggtatatccaagaatctctctattctcattcattgaggggatgatagaatacggtacaggcaaagaaccggaaaccacgcttcccccacgcagatattgtttttgaagatcggtcaacaaatctgtacgaaaaagattatttaataagaagtccgcttcattcgtaaaaggaaatttctcgtttaaggacttatttatatcaattagcgcaccgtttttatcatacagagcacctcccatgggataatatgtaaaaaaatctgtcagcaaacgctgttttacctcggaaacctccatatactttctttattaacatcaataagttacaaagaaataaaatctttgaaaatcagagaaattttaaagcataaactttaggtctatttcacaagaaaatcagtctctttactaaaaagcaacaacaaaccttcacttacgcttgttacttaacaaacaaattaattataatatgaaagcattaataggtaaaaaggcaccggaattccacgctccggcagtagtgaatggcaatgagatcatcgaggatttctctttggaacaatatgtaggcaagaagtatgtagtcatgtttttctatccgatggactttacattcgtttgcccgacagaattacatgccttccaacaaaagttacaggaattcgaaagacgtaacgtagcggtggttggttgctccgtcgattctcaattttctcatttcgcatggttaaaccaagataagaataaaggaggtatccatggggtgacttatccactcgtatccgatttttccaaaaccatctctgaaaactttggcgtattggccgctgattatattacgaacgaaagtggagaacttatctccagaggaaatccggtcgcttaccggggtctgttcctgattgacaaagagggcttgatccgtcattatgtaatcaacgatttaccattaggccgtaacgtagacgaggctctccgtatggtcgacgccttacagcacttcgaagaatatggcgaggtttgcccggcaaattggtccaaaggaaaagacgccatgaaagcgacaaacgcaggagtctctaattatttaagccatcattgatatattgcaagaaagggggctaggcccccttttttatactattgagacaatcgtttacactttcccgagatatgcgagatatctagacgtaagatattagtccggtaaaaagatttctcaatatacttttcgccgatctccttaaacgccgatgaatatttattcacgagtagccgcaaggcataccgacgctcttcttccggcaaatccaaatgcatctctccaaaagcgatagtgctctcgtaacctgtcgtgaattttcccggaacgatttgtgtagcgccaactaccgtgaaactcactttcgggttttctcgtagacattccagcttatacccttccggagcgcaatggaaataaatagaatccccttcctttacataattgatcgggattccatacccatacccatttatccccgacatggccaaaaaaccatattccgcctcctccaataaacgaattgccaactcattatccaaaatccggtcttttcgtctgatctctctaaacataggtctaatttatttataaacgagtataatacactaatcgtggcaaatctaaaaaaaaataatatacatttgcgtcataaagttgacacatgataaatattatagatctatgagagcaagaataaccttattattattcgccattctttacagtttcacttgtctggcacaaactaattttgaaaaacacttcacgaagaaaagtctccggattgatttcgcattgagtggaaattgggatttccaagccgccgctatacaacaactccgggaagaacctgtctgggcggggccggtcaaaaacttgatcgatccgtttggttatggagggtattatattaatgtatatgataaagccggtaaagagttgatctactcacgaggattcaatacgttattcgaagaatggagaagtacggagcaagcgaagaccgagacacaatcttggacaaatagcatctctatcccctatccgaaagctcctgtcatcattgagattacggcaagagacaaggccgacatgcagttccatcctttattgaaacaagagattgatccggccagtatttttattgaccgggggaaactcaaggaaaaccggatcacaaaaatccgatataacggggattcctccgggaaagtagacctcgtattcttagcggaaggttatacggcggatgagcaagagaaattcgtagctgatgccaaacgttttacggaggcattgtttaaaaccccgccttatgacactcgccgggaagatttcaatgtctgggcggtagatgccgtttcggaagaatcgggaacagatgtatccggtaaaggtatattcaagaataccgcgttgaattccggttattatacattcggtgtagatcgctatttaaccaccccggatatgaagtctatacgtgacgccgtatggaacgctccttgcgacgcaatcttcatcttggtaaacacggacgcttacggtggtggcggtatgtataatttttatgccatgggaaccgccgataacccacgtaccccggtcgtattcgttcacgagttcggacatagtttcgctggtctagccgatgaatatttcagttccgaggtcgcttatcaagatttttataatttgaagtacgagccttgggaaccgaacatcacgaccttggttaacttcgatgctaaatggaaagatcttctaccgactaatacaccgatacctaccccattagatgacgcccataaggataaggcaggcgtattcgagggaggcggttacatcgctaaaggcatttatcgcccgatggatcactgtatgatgcgtgattacgctccattctgtccagcttgtagccgggcgatcttaaagatgatcgattacttcacggataaaccgataaaacattaacaaggaaagagcgggtaccctaatagctttgttacatcaactattaagatacccgccagcactaacctatcaacatttatttcatcatcggaacttctatcaaaagaactttagcgtgcttcaagacttctatcgtaatgccatcggtttcccagaatccggccccgtcacgcttagacaggatcgtattacttacctccacctctccgtcgatcacgaataaataaaccccattatttttactatgtagcttatactcctttacttgaccggcatctaggtttcctaaagagaaccaagcgtcttggttgatcgacgcaggagcgctaccgtccggagcgatgatcaaggacaacttattcttttccgaagtaaccggacgcacgtcataactggcataatgaggcttggtattctcctcacggggaaatacccatatttgcaagaactccaattgttcattaccgctgtcgttgaactcgctatgcacgataccggtaccggcgctcatcacctgaatatctcccggcgtaatcacctcgctattctttatgctatccccatggcgtaaatatccctttaacgggatggagataacctccatattcttatgtggatgcatatcgaatccctcacccggcgccacggaatcatcattcaatacacgtagcatcccgaaatgaaccctttccggattgtaataattagcaaagctaaacgtgtgatgtgttttcaaccaaccgtgattcgcataccctctggattgagccttatcaactacaactctcatattttcctcctttttaaatctacattaataacaaatccataactataaatgttgcgggacgcatatttcgaacatttcatgtaaacatgtgattcatatatgaacagaaatcgctacttttgcacaattaaaaaaactcatcctgtaaatataaaatcttatggcaatctacttaaacgatgtatcgagaacatttggtgagtatttacttattcccggtttaaccaccaaagaatgtattcccgcaaacgtttcattgaaaacgccacttgtgaaattcaagtctggcgagaaatccgctattgaattaaatattcctttcgtttcagcgatcatgcaatcggtttccggccctaaactggcgatcgagttggctcgcaacggaggactttccttcatcttcggctcgcaaccgatcgagagccaagcggatatggttcgcaaagtaaagaaattcaaggccggattcgttatcagcgactctaaccttacgcccgagaataccttggccgacgtgcttgagctagtccgccggacagaacattctacgattggtgtgacagatgatggtacgcctaacggcaaattgctaggtatggtaaccagtcgcgattaccgtgaaggcaaagacccgatcgacatgaaggtgaaagatttcatgaccccgttcgctaaactaatcgttggcgagctaggcatgaccttgaaagaggcgaaccagattatctgggatcataagttgaatacattgccaatcatcgacaaggatcagaagcttcaatacttcgtattccgcaaggactacgatagccaccgtgagaatccgaaagagttatccggcggagataagaaattattagtaggtgccggtatcaacacccgcgactataaggaacgtgttccggcattggtagaggctggcgttgacgtattgtgtatcgactcttccgacggctattccgaatggcagtacgagaccttgcactggatcaaggatacctacggagacaaggtactggttggtgccggaaacgtggttgaccaagatggtttcaactacttggctgacgccggagcggatttcatcaaggtaggtatcggtggtggttccatctgtatcacccgtgagcagaaaggtatcggtcgcggacaggctaccgccttgatcgacgtagcgaaagctcgtgacgagtatttcaagagacacggcgtttatatccctatctgtagcgatggtggcttggtacacgattaccatatggtattagcgttggctatgggtgccgacttcctgatgatgggccgttatttcgcccgcttcgacgagtctcctacgaagaagatgaaaatcggaaacaacttcgtgaaggagtattggggtgagggatctaaccgtgcgaagaactggcagcgctatgacatgggtggaaacgagtccttgaaattcgaggaaggcgtggacagctatgtaccgtatgccggaaaattgaaagataatttaaacgtaacattgggtaagatgatcgctacgatgtgtagctgcggttccatctctatccaagagttgcagcagcatgccaagatcacgcttgtctcctctacgagtatcgttgagggtggcgctcacgacgtgatcctgaaagagcagaattaattacaatatgtattctagtagaggcgtggcacgctacgtctctactatttacacattcaaataatttaccatgaaaaatctattacttacagttatccttttgtgtttttgtttgccattcgtaaaagccgccgatcaaaagatgatcttaatctcaaccaatgagacggacttgattttacaagtagcccccaacggacggctctaccaaacttatctagggaataaattagtaaacgaatccgaatttgagaacctctcatggaatatccaagccggaacggatggcagcgtatcaacccgtggatgggaagtatatccttgctcaggagcggaagattatttcgaaccggctttcgccatccagcataacgacggaaacatgactagcatattcaagtatgtttccagcgaatctaagaaactagacaataacgttacggagacaattatctccctgaaagacgatgtatacccagtggaggctaaattacattatgtaaccttcgctaaagaaaacgtgatcaaggcttggactgagattcgtcatatggagaaaaaaccggtcacgattacccaatacgcttccaatatgctttatttcgagagtcctcgctatgtattgaccgagtttagcggtgactgggccaaggaagtacagatgagcagccaagacttgaaattcgggaaaaagattatcgatacgaaactaggctcccgtgccgccatgcacgcttacccgttttttgagattgggttaggtgccccggccagcgagaatacaggagatgttttaatgggaacgatcggttggactggaaactaccgctttacgttcgaggtggacaacgccggtaaccttcgtgtcatctccggcatcaatccctatgcgtccgcctatgaattgaaaccgaacgaatggttcgtcactcctgagtttatctttacattgagtaatcaaggaaccggaaaagccagtcgtgatatccatgattgggcacgtaattaccagatcaaggatggtaaaggcgatcgccttaccctactgaacaactgggaatcgaccggtttcaatttcaacgagaagaaattggaggaactaatgaaagaagccaagcatctaggtgtagatatgtttttgctggatgatggttggttcgctaataaataccctcgtcaaaacgataaggccggattgggcgattgggaggttacacacgataagttgccaaacggcattcctcatctggtgcaggtcgctaaagatgccggcgtgaaattcggtatctggatcgagccggagatggtaaaccccaagagcgaacttttcgagaaacacccggactgggcgatccatctaccgaatcgtgagacctattactatcgcaatcaacttgtcttagacttaagcaacccgaaagtacaggattatgtattcagcgtggtggataatatcatgatcgagaatccggatctggctttcttcaaatgggattgcaacagcccgattaccaatgtctattccccctatcttaaagagaagcagaatcaattgtatatcgaccatgtacgaggtgtctataacgtattcaaacgggtagccgagaaataccctcacctaccgatcatgctttgctccggtgggggtgcccgctgtgattacgaggcattgaaatatttcacggaattctggtgcagcgacaacaccgatccgatcgagcgtttgtatatccaatggggattctcccagttcttcccggcaaaggcaatgtgcgcccacgtgactagctggaacaagaatacctccatcaagttccgtaccgacgtggccatgatgtgtaagatgggcttcgatatcagcttgaaggaaatgaacgatgacgagatgaaatactgccaagaagcagttgccaactacaaacgtctaaagggcacgatcctcgacggcgatctgtaccgtctagtctccccttacgataccaaccattcatccgtgatgtacgtggataaggcaaaaagcaaatccgtcctattcgcttatgatatccaccctcgcttcggagaaaagactttccccgtaaagctacaaggattggacccgaataagaaatataaggtacaagagataaacctcatgccgggccagaaatcgaccttggttaccgacggaggtaccttcagcggagatttcttgatgaaaataggaatgaacgtgttctctacggctcatgcccatagcaaggtcatagagctgaccgaggctcactaactaaattgtcaacagagaatggacattatccgcgagataaccccactatcggaaaaggactgcttttacatcgtagaccggcgtaagacagaatttacctatccgatccattgccactcggagtacgagctcaatttcattgagcacgctccgggggtaaggcgtgtggtcggtgactctgcggaagtgatcggagaatacgagttagtattgataaccgggaaagaactggagcatgtctgggagcagaacgcatgtaaatcgcctttgatccatgagatcacgatccagttctctcccgatctcttcgggaagaatctattggagaaaaaccaattcaacagtatccggaaaatgttggagaaagcccaatgcggcatcagtttcccgatgtcttccatcctgaaggtttaccatttactggaaaagctggtttccgaggagcaaagcttttatgcggtcatcaacttcttaaccatcttatatgagctttctgtcgaggagaactacaaagtattggccagctcctcattcgctaaaataacagatatccattccgagagccgtcgtatccagaaagtacaaaattacattaacgaacgataccaacaggatatccgcctaaaccaactggcggaactcgtaggtatggccccttccgctttcagccgtttcttcaagttgaggaccgggaagaccctctccgactatatcaccgatatccgtatcggttacgccgcccgcatgctggtggacacgcaacgatccatcgcggagatttgttatgactgcggcttcaataacctctcgaacttcaaccgtatctttaagaaaaagaaaaactgctctcccaaagagttccgggataactacaaaaagacaaaaatcattgtataagagacctttttaacagggataaatacatatccccccctatttctatacaaaatccccccttctcttttccttcacacatctatctttgcgaccagtcacaaaggctttcatgcctacggctaccccatcgatgtgttaaaaatacactccggcaaaaaagtattattcttggataaaatagtatttgaacgcacttgggatccgacgtaattttgcgacagaaattaacaatacatattaacaacaaaaaacaattgcctatgaggaaggaccgaaaatctaatgtttttagcagttaaccgctaatgaccctattgagtaaatgaattttagtttagccttatatgatttaatgtaaaaaataatgaattcaacaattaagaaaacgacgctgtttttaggcgcatgtatggccttccagctaggtggcataccacaaatgttagccgcccctagtacttcgatggaagtcatgcaacaaacaaaaagaatcactggtaccgtgaaagacgcaacaggaatggaagtcatcggtgccaatgttatcgtaaagggaacgacaaacggagtgataaccgatttggatggtaagttcagcttagaggccgcccccggctctatcatagagatctcctacatcggttatatgacccaagagattcccgtaaccgcccaaacatccgacttacagatcaccttgaaagaggactcacagagtttggacgaggtagtggtagtaggttatggtgtacaaaagaaaaagttggtgacaggtgctacccttcaagtaaagggagagaatatccaaaaattaaacacgacaaacccgctaggtgccttgcagagccaaagcccgggcgtcaatatcgtagcgaactccggccagccgggtaagagtttcgatatcaacattcgtggtgccggaacgaacggcagcacgactccgctatacattattgatggcgtcgaaggcgacatcaattccttaagtcccgccgatatcgagagcttggacgtattgaaagatgccgcttccgccgcgatctacggttcacgtgcggccaacggtgttgtattgatcacgacaaagcagggcaaacagggtaaattacaggttagttacgacggctatgtaggtttccagaacgtatataagatgccggacttgctgaatgcaaaggaatacatggcagtcatggaccaactgaacttcaacacgggtaaccaaccttacacgtggacgaattacatgtcacaagaacagtacaaccgttacatgagcggcgaggatgagggtaccaactggcttgacgcaatccgcaacaagaacgccattactaccagccactccttgaacttggccggtggtacggaacgctccaaattctccacgggtgtatcctacacgaaacaggaaggtacgctaggcaagccggtcgcttccgactaccaacgtttcacggttcgtatgaactctgaacatattttgtggaaagagggtgacttggatatcatcacattcggagaaaacctgtactataatcataatgaatcttccggtatctccgagggtaatcaatacggtaacgacatctcttggatgttacgtgccaacccgctggttcctatctataacgagaacggggattactatatgtatgacgacttgaacaaggccggttggttcaactacaactcttatacgagtaacccgatcgccgcaatggtcaactcctcccgtggaaacaacaagagcaaaaactacggattaactatggttggctacttgaaggtacaaccaatcaagggactcgtctataaaggacaggtcagctacaaacagaactccagctcttaccgtggctacagtccggcttataaactaacctctaccgatcaaaaactaaccaatgaggttacccagaacatgacgactggttgggactggcagatcgagaatacgcttagctacaccttcaacatcgagaaacacaacttcgatgtattagtcggtcaatccttcaagaagagcggtttcggtatgggtgagtatctggaggcaacggcgaacgaccttctgttctccgactgggaccgggcttatatcagcaatagcatggcttctcagcctacctcagccaaaggatatccgacaggggataacgccttagcgtcattcttcggacgtatcaactataacttcaacgagaaatacatggctagcgtgatcttacgtacggatggttcctcgaacttcgcccgtggtaaacgctggggtacattcccttccgtatcggctggttgggtcgtgagcaatgaagatttcatggaaagcacgcacgactggatggacttcttgaagatccgtgccagctggggtcagaacggtaactgtaatatcgataacttccaatatttctcgaccgtagcgttcgaccacctcggacaatattccttcggcaacaacaagggtacggccacgcaaggcggttatgccagcatcatgccgaacgaggacgtgacatgggagacttccgagcagttagaccttggtctggatgcccgtttcctaagcggccgattgagcttgaacttcgattggtacaacaagaaaaccaaggacctgttgatcgttgccccgatcctagactcttacggaacgaacgctccctatatcaacggcggtaccgtggaaaataaaggtgtcgagatcggcttaggctggaacgaccagaagggcgactggacgtatggcgtgaacctaaaccttgcccataacaagaacgaggttacgcagatcaacaacaaagacggttacatcctaggtccggacaaggtactggccgagaacacacgtcctgtatcccgtatggaagtaggacacccgatcggttatttctgggcctataaaacggaaggtgtcatgcaaaacgccgacgacgtgcaggcttatctggataagaactgtaaaggcaacgcagccaactccctgcaaggtagctccatccaaccgggtgacttgaaattcgtagacgtgaatggcgacggcgtgatcaacgaggacgacaagaccgaagtcggcaacccgcacccggatatcacgatgggtctaagcttcaacgttggttacaaaggattcgatttagcggtaaccacctatggggccttcggacaacaaaatatgcgctcttatcgtaagtttaccgacggcaacgtggagaattacacctccgaggtatttgagtactggcacggtgagggaacctccaatcgttatcctcgtctggttccgggtaacacaggtgtcaacttccaacagatatccgatatcttcgtggaagacgctagctatttccgcatccagaacgttactttgggctacgacttcaagaacctatggaagaactgcccactgccgcaattacgtctgtacgtaagcgcccagaacctcttcaccttcacgggatacaagggtatggaccccgaaatcggtacgaacgatagttatcgcgaggacaatccttgggcaagaggtatcgacttaggttcttatccttcacccagaacttatatggtaggtgttaacattaaattttaagagaaaagcaacatgaaaaagttaatatatgcaatatgtatgggcgctgccgtagccttctcaagttgtgaggacatgctcgacacgaccaattacacagagaagacaaccgctacattcccggagtcgtacgacgatgcccagcaaatgatagcaggcgtttacgccagcatggcatccgtttgcgccaaccccgagagatcgttcctttattacgcccaactagccagcgatgacgcactaggcgggggcggctcgaacgacaagctgatgcaggccatggacctgctctgcaactatcagtccgacatgacccgccagttctggaaagaccgttatgccggcgtattccgtgccaacagcgccatagagaccttagataactgtccggactttccttccacggaagcacgtaaccaattgatgggcgaggctctcttcatgcgtgcctatttctactacgagctagcctcgatgtacaatcgtgtacccctaatcactacatcccagacaagcgacgtgccacaggcaagccccgccgagatctggggacagatcttgctagaccttaagacagccgccgacatcatgcccgcatggcgtggaggtacgtcatcccttgaggcaggacacgtcgacaagtacaccgccgaggccatgttaggccgtgcttggttgttctacaccggcatgtacgggaatggcgaagatatagccgccttgaccagcgccacttacaacccgctgacctccgtcaccttggccgacggctctaccctaacgaaggatcaagtgatctcttatatcgatgattgcgtgaacaattccggatattccttagcatccgacttccgtagcctttgggcttacacgaaccgttgcacggtgaacgatttcgaatacaccgccggaaaaggattgaaatgggtagaggatgataacgccgtcaacccggaatctatgttcgccatcaagttcaataagctggccagttggaatactaccatcgctttcgccaatggttacgcgcttcatttcggtcttcgcggagatcaagacgtagcaaataccttccccttcggacaaggttggggagccgggcctgtagcaccgaatttcgtgaacgattgggcaagcgcagaaccaaatgacatgcgtcgcgacgcttccgtatatcgtacagacaaattacccgcttataacaaaggcggttgggcggacttcgtacaggaaacggactactatgccatgaaatggtctcctgtcgcatgcaagacatccaatgacgagagtggctacttcaagaccttcgagaacgagatgtacggaatcgatggctggacgcaaggcgcgaataaccaagccttggacaacatccacgacttggtattgatccgcttcgctgacgttctcttgatgcaatccgagctcaagggagatgccaccggtatgaataaggtgcgggagcgtgccggccttccggctatcggctactcgctccaagctctgcaaaacgagcgccgttgggaattagctttggagggtacccgttggaacgacatccgccgctggcacattgccgccgctgccttgcagaaacagataggtacgcctatctacatcgcaggtaatcctgccacgaacaaggcgcaaaatggtggttacgcctcccgctacaacacctccgccggtttcatgaagatacctgagagccagatctcactctccagtgaactccagcagaacgaaggttggggagcggacgccgagtacaatggctggactaattaataaccttttaattcagaatatacaatcatgataaagaatatatattatatagcaatggcattgatcgcaggaatgatggtttcctgcgacccaatcacagaaagtgatccgggcatatccgccaacttaaccgaggcggatctgcaagcccgtgtagcgcttacgcaaacgacggccggacaaaacaagttcaccttctccaccaatcccacactgacggtacaggtattggatcaagacggggccatcctagccaccggaaccgagggttccatcattggcactcctcccctcacgagcttgaccgtccgggctatgaaccaagacggctccatcacctctttctctaacgatgtgacgatctccgagtatgtggatgtgccttctatttatgaaggattattcggaccggagtataattctgtaacttgggtttgggatacagatgccagcaacggcctttggggaaatggtgcttatatggaaagcacaggtccggaatggtggcaagttcaagccacagacatcgaccaacaatgtactgagaaaggatatgccaaagatgggttagaaggttggatgacttttaccttggctggcaagaaagtagaaaccagccgcggtcaatccggaacaatcgcatgggacttatccgctgtagccaaagaaggttgggatcaaggtacattaacgttcaccggaaccattcctttattaggactggtgaaaatgggagacactgatgataccttcgctcctcaatatgaatatcacatcttggaagcggatggtgagcatcttaaactagcggctccgaaacccggcgcaggtgattggggagaggcttggttctggaattttaaaacaagaaaataaagaaaatatatcatgaagaaagtattattcattctatattgcactattaacaacaactgttattaatatcaatgctgacgtaaatggtccatcaccttcctatgccgcagaaagagaagggtattcaaaaatgtacgttacagctcaaaatcaggacgcccatatatcaatggttattgaagatcaaaatttcatggaatatactatcaccagtggtttttatagtggaggtccatgggtttactttgttgaacatggaaagtataaagttgtttccatagataagggatatagagtctcttgtaatggatctacagttcaagtaggatctgtcataacttttagcggcgcaactgggcatattggattttacgtaaataattgatctaaaaatgaatatcacgatactcaatgttctccgtgacattgagtatctctgatcggataaatgaagaagatgtatctcactagcaatattttatgatgagattatcccaataattcattcattcttgttatataagaggggcggagcgtttatcgttccgtctcctctctttttatcttacacggtactcgccctgcaaatatccttccgtcaaccaaaccgctctccggccatctttttgatttccatagagcatttaccttgacacacctattttccgaacctagcgaaatagcgagaaagcagtagcaataagcacccctttttgttaaaatacagcgttttccacacacaataggtgccggaagcctgcgtaactagtcgtattaggcaacgccgatactgccgttgggcatcgtaagtagtcaagaatagggttatgagtagtcgcgaatgggcattcttaccctgttataaccctattgtagcaccgtttttcttcccttcctgcccccaaaacatgaaatacgatgaataaattccgctagaataaaaggccgttattcaacattagcctatcaaccaatcgattgtcgtttttttctttcgttttcgggagcataccttacctttacccgaaagaatcgattctccatgacttaaatttacaaactgtcactttgctaaaagacgcaagacaaggagatgtcaagtatccgtgaaagatgatacatcttacaacggtaagatcatacatcctacaacagtaagatcatacatcttacggcgataagatgctacaactgtaccttactgaaaataagttcgtgcattaaactccataatcgaacgttttaaactgaataacgtcgcaaatatcgcagcgtttctcctgttctaatgtcgcatcaagtacttaaaatatgtatatacacgaaagagataattggacatcattcagataggacgtttccgagcttaccgcactccttgaagaggtggggcgtaaacgaggaatgctgtatggcagacttgcctcacaccatccccaacgtctcaaacatcccccggtaaacggcggccttctcctccaacggcctcggataagctctagaggatgaaggcatacggaacagcctcatcgtccttcccatacaagaaaattccgacgagaagcccactttaggctcctccgtgccgggcaatacggagaggagggtatccatcgctttctgcccggttaccacgatcgccacgcattccggtatctgggacaagaccttttccggatcgatcggccgtaccacctcaaggaacttatcggaggcgttcgctttcaagcggatcacctccatggcggtatcaccgatcccgatccccttctcccggcagaaagccttcgccttctcctcgctgaacgccttcttgtctcgcaggaacgcatccttgttcccatagaaaatcaagccaaggatacgccacatatcattctgaatattcgggtaataaaaatccatgctccaacgagctcttggaggcgggaaactccccagcatcagcaatctcgtattctccgggaggaagaaacctagcggatgcagctcggtggtcatgcttccttgttctttttgaattccttcttctgatcctctttcgccagaagcacgacgttatacacgaagtccgtgatccattgctcggagtagcctagtttctcggcatacttacgcacgctccacgcagccttctgcacgctgatatccttccactcggacttggtcaagatatcgtgaaccgtcttcgtcgtcatattatacagcaacttcttcaccagcatggaaaagcggaacttccactgcatcagattaccaagcaagttgaacaagtcattgcagaaaccttggaacatgaagaaatacgtcttgatatcgttctggttcttgcagttcttcttcaccgagctgtcgatctccttgaagaaagcctcgcttaggccgtaatcctccatcaacaccttgcgcacacgggatttctcggcgacacccaatttgttattctgggtcggtatcttcaacatgcgtttgaacaaagccatatcggcgagcatgttcaagttggtgatacccaagttcacggccataacggcttgataatatacacggattaaagatacgaactcctccacggaacctttgccggcctcttccgcctcagatacgttcttcttgaatagcttagaaataaaattcatcgtacgattattaaatagtttcgagccgcaaatatacgaaaacttaccgccaatgcagaataactattcaattctctccaccgtaacctccggaaattgctccatcaatagcaacagtggactttcctccgtgtttttacgggccttcaacacgatgctgacgacgtactcgtccttctcctgatgccccagtcttttcatgtcatagcttaccagcaggaaacctttctcgtagataacacgggcgatccggttgatcgcctccttgtcggaggtagagaataccaccaaggaacttcgcatcccaatgcttttaaaaataacgctcaacagctccagcccggcgagcgtcaacaaagtggcggcgataccgagcccgtacatgcctgagccgacggccagaccgataccggcggtcgcccagataccggcggcggtagtcaatccccgcacgaattgtttctggatgatgatcgtacccgccccgatgaaaccgatgccactcaccacttgggcggccacacggctcggatcgagacttacgctattctctaggatgacatcttggaagccatattgggagacaaccatgatcaacgcgctacccaacgaaacaaggaagtgagtccggtaacccgcctccttcgcacggtactcacggtctagcccgacaacggcgcccagaatacctgccacgaaaagtcttagtatgaaatcccacatcataatcaacgatcttttaggttttaccccgaaagataggaattatttattgattcagccgccattcacggtgataagaatcgatcgcctcccggacggagccatgtaggagcaggagattcttgctctgctcgtaatccagacgaagctcttccatgatcatacgggtgccacggtccaccaatttttggttggtcagttgcatgttcaccatccggttccccttcacccggccaagcttgatcatcgtggaggtcgtgatcatattcagcaccatcttctgggccgtaccgctcttcatccgcgtacttccggtgacgaactccggacctactaccggctcgatggcgatctccgcctccgccgccatcggggagtccgggttgcaggagatagaggccgtcaggattccctcggagcgtgccttacgcagggcgccaatcacgtaaggagtcgtacccgaggcggctatccccaccaaggtgtcgttcgtattgatatgatattgttgaagttcctcccaagccttatccagatcgtcttccgccgactccacgggattccggagcgcccggtcgccgccggcgatcaaaccgatcaccaaggtattcggcataccgtacgtgggagggatctcggaggcgtccaagacacccaagcgaccactcgtacccgccccgatatagaagagcctaccgcctctccgcatccgctctacgatacgggttaccagtttctcgatcttcgggatctcccggccaacggcgatcgccactttccggtcctcgttattgatgccttccagcaactcccggacagacatctgatccagattatcatacaacgattccgactcggttatcttttgaaatgccataactcattcatttttttcttcgttcgtaaaatgataccggatcaatccgtccatgggagcctgtacgaccgtaccgaccttcaagcctaaggataaggccgccgctttcaatacctcctgataataataggcgatagagcctacaaaatgaatcgggtacgtatcagctcccggatataacgccacgttacggaggaaaaagctacggaaactcgtatagaccaaattataaatcggttgctcggtgatattctccaacaagaaacgggacaaggtagccaagaaacgattcgggaaaggttgtttgtatacccgctccaacaataaggcgggcgtcaactcatattgatccataaacttccgaaccaaaggcgccggtaactgacgcttcaagcaatcccctaccaataacttcccgagcacggcgccactaccctcatcccccagaatgaatcccaagggagagatatgctccgttatctccgtcccgtcatacagacaagaattcgatcccgtccccaatatacaggcgattcccggacggctcccgcataaggcacgagcagccgccatcaagtcactatacacctctatgggagccgggatataaggcgtaatcgcctcttccacgatccggttcttctccgggaaggcgcaaccggcgccatagaagtaaatggcatcgatccgctcacccttcaaggcgggcaataaggcatcccggatttctccggcgatctcctcccgtgtctggaagaagggattgatacccgccgtcacgaccgtacgcaccggtctgccttgatccgccaggcaccactccgtctttgtagatccgctatccgcaattaatatcatacacttattataatatcaaattctggagaatatataccaccgcaccagacaaatatcccgccaaggccagcagcgagatattcttcaagtaccaaatgaaattgatccgctccaggcccatcacgacgactccggcggcggaaccgatgatcaacatacttccacctactcctgcgcaataagccaagaactgccagaacacgccgtcttgcatgaagttcgccagataagccggatcagtcgccgcagccaccatagcgtccgtagccaccgggtacataccgatagcacccgctaccaacggaacattatccacgatagacgataaggcgccgataatcaggttcaccgcatacacattgcctaccgtatcgtccagccagaaagcgaaatccgacaatacgccgctgcaacgcaaggcatccaccgccaaaaggattccgaggaagaataacaaggtcgccccgtctatacggtgaaccaccttggacaagcgcaatttcaagtcctcgtcgatcggtttacgggcgtatagcatctccgtatagaaccaaagaatacccactcccatcaagatacccataaacgggggaagatgagtaaccgtcttgaatacaggcacgaacaataaacacaacacaccgatgatcaagatcgataacttctccttatccttcaatttcttcagcaactcattgtccgcctccatttgcgagaatgcgttagggggcgtcacgttgccatgcaagaaacgcatggcgatcaagaccgggatcaacgccgatacgatactcggcaggatcaaatgggggatcgtggatgaggtggagatatttccccttacccaaagcatgatcgtagtcacgtcgccgatcggtgaccaagcgccaccgctattcgccgctataataatgatactgccgaacacccaccgctctttataattcccgagcaacttacggatcaacatgatcatgacgatcgaggtggtaaggttgtccaacacggccgacataaagaacgtgatcacggcgatcaacgccagcagtttcttctttttcttcgtggtaatatgattcgtgataaacatgaaaccgccatgggcatcgatcagctccacggttatcatcgccccgatcaggaatataagtgtctcggcgatctctccgatactatccagaacctgatgctccacgacgaaccgggtacattgttccttaaacgttaaagaacccaaagaggggaacgattccaagaacaagctgaattcctctgccgaggccctcgggatgaaaaacggggccgcgtacgtgtacataacccataagaccgtaccgataagcaaagccgttcccgccttgtttatctttagaggatgttccaatgcgatcatcaaataaccgacaaggaacacaatgaccattgctgtcaacataacttcatgatttaggtttaaacgctacaaatgtagaaataataactctgtaacacgatagaaagacggaatgttttttaagataattttaccaaacatgcgaaaggaaccggactgctccgattcctttcctattctctcgagggaaaactataaccccgagacaactcactctacaaccaacatcttatcacccacggagaccttgtccgtctcattgacatacacctctttcaccaccccatcgatcggcgtacgaatctcgttctccatcttcatggcaaccaatacgcaaagcgggtctcccgccttgacctcatcgcctaccttgacatataccttctggatcacgcccggcatctgggcctgtatgacctgacggccgaccgtcttggaactggttctcgacaggcgtaatttcttcaactcgtcaatcacctgtacttggaaataatcacctttattctttacctcataggtggaatctccaacactggatatttgtacgccatgagatttatggttcatgatgatcgagtggatcgtatctccgcccagattgtaatctacatcataaacggtaccgtttacggatactttcttgataggcccgtcttccagaatctctaccttgaactctgtgtcgggaatatcgttaaccgtggcaaaataagtcgctaaagcctttgacataatcattcctcctctcattaaaagttattggccaacatttgtaacttcccgtagtgtttccacagggactcccctaccagcggaacggtcgtcgcacgggcggccgcctctttctcctcctcgtaatgcttcaaggcggcggcgatcacggcgacggtcgggtcgctgttctggcgacgcttcaagtcttccttatcgaacttagtgtcgataaaggtcgtatcgtaattccccttcaagaaagtcgcattatgcaacacacgcaggtggaagggaatcgttgtcttgattcccaagatcttgtattcccgcaaggcacgtatcatattcgagatggcggactcacgggtccggccccatgtgcaaagcttggcgatcatcggatcgtaatgcaaggacacctcgaaaccggcgtaagcggcgctatccagacgtacgttacgtccctcgggagcctcacgcaccttgatcacgcccggagagggcataaagttattttccgggtcctccgcatagatacggcattccaaggcatgcccccggcaagccacatcttcctgcttataaggcagacgatttcctgcggccaccaagatcatatcgcgaaccaagtccacgcccgttgtctcctccgtcaccagatgctccacttgaaggcgggtattcatctcgaggaaatagaagttctggtccttatccatcatgaactccaacgtcccggcactgtagtaaccgattttcttgcaagcctccaccgctacggccaacatcttctggcgagcggcctccttcacgaatggagagggcgcttcctcgatcactttctggttacggcgctggatggagcactcacgctcatacagatggatcacgttcccatatttatccccgagtacctgcacctcgatatgatgggggttctcgatatacttctcgatatagatggcgtcgtttccgaatgagttggcagcctcggaacgagacatacggaaagccgcttctatctcatcctcgctatgtaccaaacgcataccctttccaccgcctccggcaagcgcctttagcataatcggataacccacctcggcggctactttcttggcatcctctatgtccgtcaccggcttttccgttccgggtacaaccggcacaccggcttctttcatgatcttacgggcctcggtcttgatacccatcttcgcgatcacgtcggcgctcgggccgataaagatcacgccctcctcctcgcaacgacgggcgaagtcggcgttctccgacaaaaagccgtaacccggatgaatggcggctcctgtcttcttggcgatctcaaggatcaagtccggcttcaagtaagaggtatccgcttcatcttccgagatgcagtaggcttcctccgcataacgtacatgtaatgctccgcgatccacatgcgtatagatcgctacggtcgggatgttcatcacccggcaggtgcggaatatccgcatcgctatctcgccacgattggctactaatactttctttatcataaggattcgtttttaaagaggaatattggaatgcttcttcggaggattggattgccgtttgttggccagcaactcaaaactacggatcaagcggctgcgtgtgatagacggctcgatgatctcgtctacatagcctaactcagcggcccggtacgggttagcgaacttctcccggtaatcggcttgcaattccttccgtttgccttcgggatcttccgcggtcttcaaatccttacggaacaagatattcacggcaccatccggtcccatgacagcgatctcggcggttggataagcgaagttgatatcgccccggatatgcttggagctcatcacgtcgtaagcgccaccgtaagcctttcgggtaatgacggtcactttcggcacggtagcctcgcaatacgcatacaataacttagcgccatgacggataattccctcgtactcttggttcacgcccggcaagaaacccggtacatccaccagcgtcaacaacggtatattaaacgcatcgcagaaacggacgaaacgggcggcctttacggacgcgttgatatccagcgtaccggccaacgcagcaggttgattcgccacgacaccgatcgtctttccattcaaacggatataaccgataatgatattcttggcatattcctcttgtatctcgaagaagttttgatcatcagccacggaaaggatcaactctttcatgtcgtacggctggttgggattggtaggaaccagcagatccaattgcggatcgatgcggttcgggctatcggtggtagggacgaatggcggctcttccatattattattcggcaagaacgacatcaactcacgtatcttcaagatacaatccatatcgttatccgccgtgcaatgagccactccggaacgggtgctatgcacttccgagcctcccagattctccatcgtaacctcttcttgcgtcacgcttttcacgacctccgggccggtgataaacatatagctcgtttgttttaccataaagataaagtccgtcaacgccggcgagtaaaccgctccacccgcacacgggcccataatggcgctaatctgcgggatcacgcccgaagccaacgagttccggaggaatatctcggcgtatcccgccaaggaacgaactccttcttgaatacgtgcgcctcccgaatcgttcaacccgatcaccggagcgcctagttccgttgccatgtccatgatcttacagatcttacgggcatacgtctcagacaaggctccaccgaataccgtgaagtcctgagcgaaaacaaataccgtgcgttgcccgatcattccgtaaccggtgaccacgccatcccctaatggacgctgtttttctaaaccgaactcatggcacgtatgtgtcacgaacttgtcgatttccacgaaactacctttttccaatagtagttcgattctttctctagcggttagtttacctgccgcatgttgcttcgcgatgcggtcttctccgccccctaactcagctttgtggttgagagcttttaattgttcaattttttccttcatggcgtatctctttaattatccgggaaacgttcaatatattagaaaacaaagtctgtaaatgtattgtttcctaaagaaacgaaatgtatcatatattacatctatcgcccgatcaatgagatctatcaagaaggatattttttagtaaatactgaaatcttgcggcttgatcacgaaaccgatccgcagcatgcttttgtattgattgtattccaaaaggttctcaccgtaaccattataatattgcaggaagaaatattggttctcgttattattaaacttatagctcaactcgatctgagtgttaaagctgaaccaagtctttcgtttggtcaagataaccccgcagttaaagcgcctgttgtctgtccggtaattagcggctacttggaatataccattatatttaaggatgtctttattttccttgccatccacgatcggtatccagcccttgaattgaacttcccagttcttattcaacaggacagccgccgctagggtgatcttgttccaacttcgggagaagatgctatctttaccgttcgactcgtgctcgaccatcaaatagcctttcccgatatatttattcttatgcacgataaggtgccccaaaccgatacccggattaaaattcaagtcgcgcatcggcaaggactcttgaaagacattccaaaaagccttttgcgtgtattgcaagaaaagataggtatcgaaggggagtttacttttcgtaagacgttgggcgatgctcaactggaatttaacgtcggagtttctcgccgtaggcttgttgccgatagggataccgccaataaaataattgtccttgaataaggtaaaataaggtgacttatccaaaatcgcacgaatactatccgcgttataactctcttccggccctttcgctaaaacttgcgaatgtgccataccgcaaacaaaaaggaagagaaaggatataatcgtttttttcataaatgatcttaaattataaatgtgtccgcgaatataggggaaacggcagttggctttatcgcccaaattacatgaataatggtcatttcacctatgaatataatatataaaccaaaattcaagaggttagttcatttttcctatattcgcggctatggaagaaatctatagttattacaaagaaaatatcgacgcttatacacggcgcttgggtaatttgaaaaagaagatccatttgatggggagtatccggttggctttagtggtgggagcgatcctctccttatggatattcagggatgagagttggcaatggctgacagggatcaccttcgcttatatcatcccgttcgcgctcctgatgtggtaccataataaaatgtacgcacgaaaagtatacgccgagaccttgatcaaactgaacgaggatgagctaaaaggactggactatgatttcagtgcgttcgacggggcggccgataagatctcgggcgagcactctttctgcttggatctggatgtgtttggagaccgctccttgtttcaatcgctcaatcgtaccgtaaccgggttcgggcgggaacgactggccggttggctctcgaatcccttgacggataagaaggagatcgtcaaacggcaagaggctgtcaaggaattagcgactttatccgccttacggcagcatttctatgtgacgggaatcatccggcaggacacgcaagatacgagagacaacgatatcaactttatggaccgactcactcagcgtaagcataaattcgttgatagcctaccgtggaaactattgatctgggcggtcccagtgttgtggatcgtattgggtatcgcttactcgctggattggatcagcgggagtttattgaatatttatttcttaatcacgttagtgatcgcttacggacgagccaaggaaatcaatgcgctttacgcgaccgtcaataagatggagtctattttcaatcggtactcaaagctgatgcaatgtgtggaagaagataatttccagtcggaagagctgaaagagatcagcgggcaattagcgaatgagaaggaattggcctcgcatgctatcaaacgcttgtcgtcgtatatcggaggattagaccaacgattcagtttggcgggtatcattttcaatctcttctacttgcgggatacacgccatgccatccttttggaacgctggattcagacttactccgataaacttccgctttggttcgacgcgctggctcgtttcgacgcgctgaactcgttgggtggtttcgctttcaaccatccggaatacatctatccggagattgccgacacttatttccagatggaaggcaaggctttgggacatcctcttttgaaccgggaagtctgcgtaaagaacgatatcgatatccgcaaaagtccttggttcctgattatcaccggagcgaatatggccggaaaaagtacatacctccggacgatcggtgtcaattacttattggcttgcgtaggcgctccggtctgcgccgcctccttgacggtttatcccgcccacatggttaccagcttacgtacctcggattccttggctagcaacgagtcttatttcttcgcggagttgaaacggctgaaaatgattatcgacaggctgcaaaacggggagaagctatttatcatcttggacgagatcttgaagggaacaaattctatcgacaagcagaaaggctctcttgcccttatgaaacagctggtcgcttataaggcttgcggcatcatcgccacccacgatttagtgttgggtactttggaggaagagttcccggaacaaataaagaattaccgcttcgaagcggatataaaagacgaggagctatccttctcttatcaactaagagaaggaatagcccagaatatgaatgcttgtttcttaatgaacaagatgggaatcttgtttaattgaaaattgagacaagtgataaaataactgtcacttgtcaactgccaactactttttgtatttggttttgattgcgggtaggactttttggatttccgctatacgagtggcatcactggggtgcgtactcataaattccggcgtagagccactctttccggcggacatcttttgccagaagttgactgccacgtccggattgtatcccgccatagtcatgaataccaatcccatataatccgcttccgactcgtgcttacgggagaaaggaagcattacgccatactgcgctcccacaccatataccgtattggccgcttgctgtaccgccgcactcttattgcttacggccgcacctaaaatagccgccccgtattgggccattagttgctggctcatacgctcattgctgtgtttagctacggcatgggcgacctcatgcccgatgactaccgccaattcatcgtccgaggaaaccaatggcagcaatccctcgtacaccacgatcttgccgcctggcatacagaaggcgttcacctgcggatcattcaccaaattaaactcccaagagaagttttttacctcatccgccatcccgttcgcccgcaaatagtcctccgtagcggcggctatcttctttccgacccgggttaccatagcgctcttgttcacgttcgtcgattttttcgccgtctttatataatcgttatactgggtaaggctggacgataacacctcttggtccgaaaccaacagcacttgcttacgtcctgtcaacggtacgctggaacagcctgccaataaaagcaaggccacgaataaacttgctatttttctcatatccttttacttgaaattaaacctgatactctctttttaataacgcaaagatactaccattttgttcaaaacgaccacaccctttcgttctttctataggaagtattagcctttcctttgaatgacattcatcatctatcatccgttgcatgatcatccaccaattggtagatgatcttctaacagctgttgcatgatcatccaatggctgatagaagacgaatataaatagatgaaatgcctaacacttacagtgattaaacctaagctaagcaggaaaatcccttaccccctacttatatcagaaaaaaaagcccttgattgtatatttattcaacaatactctttatatttgcagcctgttttgcataaatatacaacatgagtacaaagaaggaacgattggatgccatttgcggtattatacaaacgaaggtgataagtaatcaagaagaactgcttaaagagttggaagatagcggattctcggttacgcaagctacgctttcccgcgacatcaagcaactgaaagtagccaaggtacacgacggaaacggagattatgtatatcgccttcccgaagagagtataagcaaacaagcacagcctgaaggcaagaaaaagccgaatatcgagttttccggaaacttagcggtggtgaaaacacgaccgggttacgccatgggaatcgcctcggacatagactcccatgcccccagcgagatactggccaccatagccggagacgatacgatcttggtaatcccccgcaacggtgtgagccaagagaaggtgattgccgctttatcacattttatataaaaggaaaaaactaagaataaacaataaaatggaacaagaaatagaaattgatgttatgatcgctgatgcctctcacgaggtatatgtggatacgatcctagatacgatcgagtctgccgctaaagtccggggcacgggtatcgccaaacgtacgcacgagtatgtggcccagaagatgaaagagggcaaagcggtgatcgccttggcgggaaacgagttcgccgggtttagttatatcgagtcatggggaaacaagcagtacgtgactacctccggcttgatcgtgcatccggatttccggggcttgggtatagcgaaacgcatcaaagacatgaccttccagcttgcccgcatgcgctggccgaaggcgaagatattcagccttacctccggcgctgccgtgatgaagatgaataccgagttgggatatgtaccggttacgttctccgacttgacggacgatgaggctttctggcggggttgcaacggttgcgtgaaccacgatatcttggaacgcaccgaacgtaagtattgcatctgcacagccatgctgttcgacccggccgatccgcatcgtgcgcaacgagagcgggaggcacgtaatcagactaaaaaggactaaattaatacgatagaaaaacaacataaaatagagaaacgatgaagaagaaagtagtagtagcgttcagcggaggtttggatacctcattcacggtcatgtatctggctaaagagaaaggatacgaggtatacgccgcttgcgctaacacaggtggtttcagcgaggaacaattgaaacaaaacgaggagaacgcctataagctaggcgccacgaaatacgtgacgatcgacgttacgaaagagtattacgagaagagcttgaagtacatgattttcggaaacgtgctgcgtaatggtacgtatccgatctccgtaagctccgagcgtatcttccaagccttggcgatcgcccgctacgcaaacgagattggcgccgacgctatcgcccatggttctaccggagccggtaacgaccagatccgtttcgatatgactttcttggtattggctccgaacgtggagattatcacgttgacccgcgatatggccttgagccgcgaggaagagatcaactacttgaaggagcacggtttcgaggccgatttcacgaagttgaaatattcctataacgtaggtctttggggaacctctatctgcggcggcgagattcttgattccgcgcaaggattgcccgagagcgcatatttgaaacaggtggagaagactggcagcgagcaattgcgcatcgagttcaagaacggtgaggttcatgccgtgaatggtgaggtgttcgaggataagatcgccgctatccagaagatcgaggagatcggggccgcttacggtatcggccgtgatatgcacgtgggcgatacgatcatcggcatcaagggacgggtcggtttcgaggctgccgctcctatgttgattatcggggcgcaccgcttcctagagaaatatacgttgagcaaatggcaacaatactggaaggatcaggtagcgaactggtacggcatgttcttgcacgagagccaatatctggaaccggtgatgcgcgatatcgaggcgatgttgcaagagtctcagcgcaacgtgaacggtacggctattctggagcttcgtccgttgtccttctctaccgttggcgtagaatctgaggacgacttggtaaagacgaaattcggtgagtacggagagatgcagaaaggctggaccgccgaggacgctaagggcttcatcaaggttctttctactccgttgcgtgtttattatacgaaccataaagacgaagagatatgattaaatgcggaattataggcggagcgggttacacggcgggtgaattgatccgcctgctcctaaaccaccctgatgccgagcttacatttataaacagtagcagtaacgccggtaacaagatcacggacgtgcatggtggtctttatggcgagacggatttggtgttcaccagcgagttgccgttagatagcatcgaccttctgttcttctgtaccgctcatggcgatacgaaaaagttcatggagaaccacacggttcccgagaacgtgaagattatcgacctgagcatggactaccggatcgaaggcccggagcacgatttcgtgtacggcctgccggaattaaaccgccgccgaatttgcaacgcccggcatatagcgaaccccggttgtttcgctacttgcatccaattgggcgtattgccgttggcgaagcacttgatgctgaattccgacttgcatgtcaatgccatcacgggttctacgggagcgggcgtgaagccttcttccacctctcactttagctggcgcaacgacaacatatcaatctataagccttttacgcatcagcacttggccgagatcaaccagagcttgagccagttgcagaagagctattcaagccggatcaacttcatccccgtacgcggtaatttctcccgtggtatattcgccacgacatacatcgattgcaagatcgacttggtagagatccgacgtatttatgaggaatattatgatgatcacagcttcacgtttatcactgataagaacccggatttgaaacaagtggtaaatacgaataaatgcttgatccacttacagaaaatagatgataagcttcttattatctctatgatcgataacttattgaagggcgctagcggccaagcggtccacaacatgaacttattgttcgggttggaggagacggttggcttacacttaaaaccctctgcgttttaaaaaatactataaagatgaatttattcgacgtatatccattatttaatatagagatcgtacaaggcaaaggatgccatgtatgggatagcgagggaaacgagtacctcgacttatatggcggccatgccgtgatctcggtgggtcacagccaccctacttacgtaaaggcgattaccgagcaggtaaataaattaggcttttactcgaactcggttatcaatagcttgcaacaaaaattagcggataagctagggaaggcttccggctacgatgattattcgttgttcttgatcaactccggagcggaggcgaacgagaacgcgttaaaactggcctcttttcataatggcaagaagcgggtgatcgcattcaagcacgcctttcatgggcgtacctccgccgccgtccgtgtcacggataacccaaagatcatcgctccggtaaatgaggatctagcggttacttatcttccattgaacgacgcttccgccgtagaggaagagttgaagaagggggatgtatcttccgtgatcatcgaaggtatccaaggtgtaggtggcatccagttaccaacggatgattttatgcgtaagttacgcaacttgtgtacggcttatgatgcctgtctgatcttggatgagatccagtccggatatggaagaagcggtaaattcttcgcgcatcaatatgccggtatcaagccggatttgatctcagtagcgaaaggtatcgccaatggcttcccgatgggtgggttattgatcagcccgaaattcaagccggtttatggtatgctcggcactactttcggcggtaaccatttggcttgcgcggccgctatcgccgttctcgatattatggaagacgagcgtttgattgataacgcggcgaaagtgggtgcctatttattggatgagcttcataaacttccgggtatcaaggaaattcggggccgtggtttgatgatcggtatcgagttcgaggaatctatcaaggaagtacgtagcaaacttctctttgaggagaaagtgttcacgggtgtagccggaacccatacgatccgtctgcttcctccgctttgcttgacgatggatgaggccaaggaatttatccgtcgcttcaagaaagtcctaaacgcttaattgttctttatttcataaaaagggaggatgtctgaattagtgtcctccttttttccattcctccccaacagcgacgtaaattaagtatcaccctttgtcaaaaaaacatcattcccttttccgaaaaaatactaactttacgcagtctaaactttgagtctctaattactaatgaacacgatcgatgaaatatctatttataggagtattcactttattgtgcctatttgcctgtcaatctaacgattccaaatacatcatagaaggcaccctacccaccgcacagcaggatggggaatggatttatctggcacccatggaaaacgcctcaatcgaaaatatcgattctacgagaatagagaacgcacggtttactttccaaggaacgggagaagagatgaaagtcctccgtatgcgcatccttttgcgtctcaagttccaagagctactggtcgtaacggaaccgggtgtgacctcagtacggatagactccatcagctcggcctccggtacaccgcaaaacgacgccttgcagcattggaaagaccggaagcaaaagaccgatagcgaatcctatgccctatggacagcgcttaagacttgctcgccggaagattccatccgcatcaagcagacatgggattccttgagagtagagacgcaagcttttaattatgcgttcatgaaagaacatatcaaccaaacggtcgggaaattcctctataagatgataaaaacctccttgaccgaagagctacgaaaggaactggatgaagcgaatcattaaacaggatctgtcgatcacgctagcggtactggcgatagcgatcttcgctttcttcttctggatgtacccctatcatttgttccacaaagagcaaatgatgctgttcttgtacagcggcgagtttctccgtggatattttcaggaggaagcgtggctggcttgtctcaccggcgatttcctcacgcaattcttttattatatcgggggaggcccgttcatcctaagcgttgtcttaactttatttgccctgcttacctatcagacattccggcaattcgtcagcaagagatacgcccttcctcttatgatactacttgtattatgggaggccggaaggtcttgcggactcgcctatccgttatccgcgactctctccttgatcggagcagaaggtgttttcctgttatatagccggagccaaactgaggggcaacgtcttcttacctgcattcccgccatgcttctttgctattggtgcttcgggtacggggcatggctctgtctggcccttatgctggccgccggaatcatagcgcaccatcaaaagctaagtgccctgcttgcggcaggtatattacttcttccagcgacccaatatcccgctaccacttggtggagtaagccggatctcgaccgggagtatgtactcagcctcgatgtggaacattatttcggaaatatacaaaagatgaggaaacatctcgagacagaccgccaaatcctttgggtgacctattaccggaacctgtacaatgccacgcatccgtccgagatcaactcacccgtatctctctcccggaacctcctagcgtggaatcaaccgggtacgaatgggttgatcctccccgtgaacccatccgcttcttttctctctatcctattcgctaacgagttatggtttacgttaggagatatgaccatggccgagcattgcgccatgctaagtatgatcttctctccccgcaattcgggtagccgtatgatcaaacggctggctgagatcaatctggtcaatggggatgatgaggcagctcttaaatatctacgtatattagacaagacactccttcataaaagctgggccgaaaagagaatacccggtcagcaaaccccgcgagtaaaggagtggctggagaagaaacgcagagacatcccgacccaagaccatctacgttccggtaacgatgccgtgacttccttacggaacttagtcgcctcgaacgccggcaatctccgtgcttacgaatacttactctgctatcatttactctctaaagatctccgttcttttgtagaagattatgtaccgggtaaggtctctagttccattttcgccgaggccctgctgatccatctcgcccgccaaggtaatatccgtgcggaagagcttataaaataccaaatcccggtaaagatagcgaaagaattcgccgattatacccggctttatgaggcaaaggacacgagtttgaaagagaaatacggcaagacctattggttctattatcattttgcgaccacagagcccggaaaggagagtaagccatgaaagaagcaagaatcatgaaagagaacataacctattacctcgtctggataatctgcttgctggcaggatgtacccctaccccgaagcaaatagaggataccacagacccaatccccatgtatcccgattatacggatatcatgattcccacgaatattgcccctctcaacttcttattgagaaacgatgcggacgctatgcaagtaaccttaaaagggaaatcaaaagagatacaattatctttcggaaagaaagctattttccctttaaacctatgggaaagccttttagagcaggaagtgggcaaccgcctgcaaataaccgtagtcgcccgtatcaagggtaaatggtttcgttacccctctttctactggcaagtagttccggagaaactggatagttacataagctaccggcttatagaacccggctacgaggtatggaacaagatccaattatgcgagcgggagatcaataccttcgaggaacgggttattgccgacaacaaagataccgacggttcttgcatgaactgccatatttacggaaataagaaaggaagtttatccatgttccatttacggggaaagcaaggaggcaccctgctgaaccgtaacggacatttgaggaagttgaaattgagcaacgacagtctgccgaatggggctgtctatggcgatttccatccatcggggcagttcgccgttttttccacgaatattatcatccctgcttttcattcgttaggaagtaagcggttggaagtctatgacacaacctccgacctagtggtcgccgatttcagaaagaaacaactcatcacctccccattgactagccggaaggatgagttagagaccttccctaccttttcgcccgatgggaactggatctattattgctccgctcccatccagccgttgcccgatagcatccatagcctaaaatattccctatgccgcatatctttccataaagataccaaagaatggggccaacggatcgagaccgtatgggatgcccagaagcataatggctccgcctgccatcccaagatatcgcccgacggtaaatacctgcttttcacggtagccgattatggaaccttcccgatctggcaccgagaaacagacctgcatatgatgaacctccagaccgggaaaatagataccttacctgccgtcaactccgataaatcggatacctaccatagctggtcctctaacagccattggtttgtctttgccagtaagcgggatgacggactatacggaaagccttatttctcttacgtggatagtacgggaaaagcctataaaccgttcgtactcccgcaagaggatccggaacattacgatatcacgttgaaatcttataatatacctgaattatccactagcgagcttcctttcgacgctgaagatgtacaagagatctactacgacgaggaagctgagacttttaaataatagaatcatggaaaatacacgtaaatatagatacataagaggaatcgcctccttattattcggctgtgcgatttgcctgttttggggactttattatcctcatcatttacattaccacgagcaattccagttattcctgttcacgccggaatatggaatcgacaaatgtctccatcccggaggtatcgctgaatatatagcggagttcctgacgcagttctattatttcgcttgggcaggggctactatcttggcgatcgttctcgtgcttatccaacggcaaataaactggctggccaaacaaatggggacttccgacttttggtatccgttcagctttctcccctctatcctgctctgggtatttttatgtgatgagaatgccctgctggcattccctgtctccataactctcgccctcttcgccttaatcatccagcgaaaaatcactcatccatggggacgaataatctatacgctcctaataatgccggtactctactggatcgtaggtggtggggcctatttcatcttcgttatcggagtagcaatcgggcattgcatcaaacccgtaccaatcgtatccaacaaatcctatatatggattcctatctacatcttgcttggaatcctatgccccctattggcacaaagccttacgcaatatccattgcttagcctcatgaccggcatcgattattatcgtttccccatgatcgttcccaacaccctgttacttgttattgctaccgttgccataacccccggggcacttgctttatttcccccacccgtaaagagcactaaggcatggatgggtattatctccaccctgctccttatcggtggtggcacatggatctatgccgccagcaattcggataaggaggaggctatgaaatacgactacctcacccgcatgaaacaatggaaccagatcatcaaggcggcggaaaacaaagagcctaattctcctttctccgtgacctgcttaaatctggctctcgccaagaccgggcaattaggggatcgcatgttccatttctaccaaaatggaacggaaggattgatccccaccttccaaagagatttcacctcaccgctccctaccagcgagatattctatcatctgggaatgatcaactcctcacaacgctatatgttcgaagcgatggaggctatccccgactataagaaaagcggacgtgcctatatgcgtctggccgagaccaacttgatcaatggacaatacgctgtcgccgccaaatacctgcgggctttgcagcataccttgttctataagaaatgggcgaccaacgccatgagctatctaaataacgatgaaaagatagagaagcatcccgaatggggatggttgagaaaagcccgatatacagaagatttcttgttcagcgacacggaaatggatgtcatgctaggcttattgctgcaacataacaaaagtaaccggatggctttcgagtatatgttagcctatgtcttgcaaaagaaggatctggaacgtttcatgaaatattatccgcagggaaaagatctgggctataaccacatacccatctcttatcaagaggcattgattttcatttggacacagcagcatcctaatttccaaggccttccttggagcatctcccgcaacgtattggaaggggtaagcgagttcgcccgtgtttatatgacgcagaaagactccgagcctatccttcgcccaaaatacgagaagacattttggtattacttattattcagaaaataaacggccatgagaaagcttatcttattatatagtatatgtatagcgttatttaccgcttgtggggattcggtagtatcccccgaacaaatagagaaatacccgtccatctatccggattatatcggggtgacaatacccgccacgatagcacctatgaatttctcttatacggatacctcctatgagcggatagatgttatcgtaaaagggtgccaaggcaaagaggtgcatataaacgcgaagcatgtcaatttcccggaaaaagagtggaaacaactgctcatctccaatcaaggcgatagtttactctttactgtcagtatcaagcaagagggtaaatggagtacttacaaacctttccccatgtacatcagcccccacccgatcgattacggcttagtataccgaaagatcgctcccggttatgaagtctacagccgtatgggtatttatgagcgtgatctatcgtctcataaagaaagacctttggtggaaaacacgctggtcaaaggtatgtgcgtaaactgccatgcctttaaccgtacggacccgagccatttcagtcttcacatccgaggaacgcatggagccacttttatgagaaccgacaataaggatgaatacctcaacacgaaaacagatcagacaatcgccgcttgcgtctatccctactggcatcccggaggcgaatatatagcgtattccacgaacaacacccgacaatcgttccatacggttaaggacgagcgggtagaagtattggatttggaatctgatatagtcgtttaccatccggcagatcatcgtctactcctttgcgattctttgcaaaagaaagacaggttcgagaccttccctgcgttctccccggatggtcgtacgctttacttttgttccgccgaagctaaaaagattcccgaagaatataaagagataagatataatttatgtagtatcgattttgatccctctgccggtacattcgggagccgtatcgatacgttggtgaacgctgaggctttagggaaaagcgtatcttttccccgcccttcctatgacggcaaatatattatgttcaccttatccgattacggaaacttttcgatctggcataaagaggcgaatctatggttactggacttgacaagcggagacctccgcgagctatccgaagtaaatagcgatgataccgaaagctttcacaactggagtagcaactcccgctggtttgtcttcagtagccgccggggtgacggcctttatacccacctttatctggcaagcatggatgagaatggcaagataagcaagccctttctccttccccaggaagatccggaaacctattacgatcgctctgtctattcctataatgtcccggatttcgtcaatgcccctattctgctggacacgaaagtatttgagaagaggataacttcaaaagagcgtatacaggttcaagttgggaactagaaaccaagggttaccaaaaacaatacacggatcttatagaaaaaataaataattccataagatccgtgtattgggtatagttctatatctagatgttcgctataggttcttcagccatttcttaccggatttggtataagtccatgcaagaaatatccccattaccacgataataattaaaaacaaaaatgtcatgttattcatatctgttattatttaaatattctatttgcacaaaccgcaatcattcctgtacctcctaaacctgttatgagcattacccactgtgaaaaatcattcggattcttatacaacgggataaccccacatataactacacccgcaaaagtcagtttcgccaaatcataaaagaactttcccaaattctcctttcgggctttctctcattctctcccttccttcacttgttcttgtaaatcattccattttcccatagtcattctatttgattaattaacatgcacaaagataacaatgaattccaaatcaaacaaccgttccggttaaaatgaaaataatatcgctatcagataaaataatactagattgtctgcccgatacctcttacatttgcgttcataaagaaagacagttatcatgaagaacacgaaattaattaccatgttatgcctaggggcactaatcgcctgttcaccgtcgaagaaaggactagaaccgacaagcgaacaggtttcgccgagagaacgtttaatagagaacctacgtgcgactccacaaaaaggaatcatgttcggacatcacgatgatacggtttatgggatcggatgggaatttgacgaaggaggctcagacgtgcaaaaagtatgcggcgattatccggccgttatcagctttgatcttggagagatcgaactcgggggagataaaagccttgataaagtacctttcgagaaaatacgcaaggaaatcatcaaccaatataaccggggaggcttggtatctttaagttggcatccccgtaaccctaaaaccggaggggacgcttgggacgtatcagaccatgctgtcgtgaaatcgatccttccggaaggggagaactatgagaaattccaaagttggctaggcaaagtgaatgatttcatcctttccttgaaaacaagcgatggcaccaagattcccgtcctattccgtccttggcacgaacacaccggaagttggttctggtggggacagaatttatgtaccacggatgaatacaaggcgctatggcgaatgaccgccgattatctaaacgctcacggagcggcagaccagatcgtttacgcttattccacaggtacggagccgcgggatcaagcgtcttatctggaacgttaccccggacatgacttgatcgacgtcctaggcttcgacgcttaccaacgggaagataaggatttcttcttgaaaagcatggataccagtctttccgtaatagacagcataggcaaagccaaccataagatcatagcgatcacggagaccggctacgaaggggtaccagactccacatggtggacgggaaccctgctgcctgccatggagaaatatccggtcgcttatgtattggtatggagaaacgcccgtgaaaaagtcactcacttttttggcccttatcccggacaagcctctgccgaggatttcaagaagttctttgaaaatccgaaaacattgttcgcctccgatatcaacctatataaataacatcatacataaaccagataaatcacgtcatatccagttgtagagacggggcgtgccccgtctcccaccatctgataatatcatttaaagcaaaaacatcatggaacaatttcaagaaaaagtaaacgaactcttcgctaaacacgaaaccttgttaagccggaaaaatatccctttagaagacggaaacggaatcttcacccgttatcaacaccctgtactgacagccgcgcataccccgatcttctggagatatgacttaaatgaaaagacaaacccctacttgatggaacgcatcggcatgaacgcaaccatgaactccggtgcgatcaaatggaatgacaaatatatattaatggtacgtgtagaaggaagcgaccgtaaatccttcttcgccgtagccgaaagcccgaacggagtagacaatttccgcttttgggattacccggtaaccatgccggacgatcttgtcccggccacgaatatttacgacatgcgcctaaccgctcatgaagacggctgggtttacggaatcttttgcgccgagcgccatgacccgaacgcagctcccggagatctatcctcggcaaccgccacggcagctatcgcccggacaaaagacttgaaaaactgggaacgtctcccggatttaaagaccaagagccaacaacgtaacgtcgtattacatccggaattcgtaaatggcaaatacgccctttacacccgcccccaagacggatttatcgacgcaggaagtggcggtggtatcggatgggccttgattgatgatatcacgcacgccgaagtcaaggaagaaaccatcatcgaccaacgttactaccatacgatcaaggaagtgaaaaatggcgaaggcccccacccgatcaagacaccgagaggctggttacatctcgcccatggcgtacggggatgcgccgccggattacgttacgtgctttatatgtatatgaccgcattggaagatcccacgagacctatcgccacacccgccggctatttcatggctccggaaaatgaggaacggatcggcgatgtatccaacgttttattctctaacggatggatcgcggatgaggatggaaccgtgtatatttactatgcgtcttccgatacccgtatgcacgtggctgtatccacaatcgataaattggtagattactgcatgaacactccggccgacgggctgactacgaccgcatctgtcgagacgctgaaaaagctaatcgatcgaaatcttccactcctgaaataacctacaaaaaccactcatatgattaaactaacagagaagataggctacggtttcggggacatggcatcgtccatgttctggaaactgtttggcgcttacttgatgattttctatacggacgtattcggattaccggcagcagccgtaggtacgatgtttttgataactcgtatatgggactcggtctttgacccgattgtcggcgttgcggcggatcgtacgcaaacacgctggggaaaatttcgcccttatttgctttggctggcgatcccgttcgccgctatcggagtgctcactttcatgactccttctttcggacaaacaggtaatttgatctatgcctatatcacctattccttgatgatgatggtgtactccgctataaacgtgccttatgcgtccttgcttggagtaatgagcccgttgccacaagaccgtaataccctttctacgtaccgtatggtattcgcctatattggcagttttatagccctgttgctattcatgccgatggtgcgtttctttagtggaaatagcgatgaattggcggatcaacaacatggatggaccatggctgtcgtagttatcgctatcctgtgcgccattctcttttatggatgtttcgcatggacaaaagaacgggtaaaaccgattaaagagcaacaaggctcgttaaaagatgacttgagagatctattgcacaacaagccttggtggatactattgggagcaggtgtctccgctctggttttcaattccatccgcgacggggctaccgtatattatttcaaatactttatcattgaggaagcctatgccaatgtatctcttttcggagtctccttcgtcttaagcggattatatctggcggtaggacaggcggccaatattgtcggcgtgatcttggccgccccattaagcaaccagatcggaaagaaaagaacctatatgggctccatgctgatcgcctcggttttaagcatcctctttttctggctcgacaagacggatctagccctgatattcacgttccaagtgttcatcagtatttgtgccggtagtattttccccctactttggtccatgtatgccgattgcacggactactcagaactaaaaacagggaaccgtgccacaggattgatcttcagttcctcgtccatgagccagaaattcggatgggcgatcggcacggcaatcacaggctggctactcgctttcttcgggtttcaggccaataccgtacaaagcgaggaaacgattagcggaatcaagatgttcctcagtttcttaccggccgtaggtacgatcctgtccgttgtatttatcgccttctacccgcttagcgagacaaagatgaaggaaatcaccgctacgttagaaaccaaaagaaaagaaacaaatgaataaaatcaccgaagatttacaaaacgaggttcaatgggagctagagaacaatatcctccctttctggatgaaccgaatgatagatagtgagtatggtggtttccatgggcaaatcacgggaaacaatcaacgagtcgtacatgcccctaaaggcgccatcttgaacgcccgtatcctatggacattctccgccgcataccgtttattacgaaagccggaatatctggaaacggcgacccgtgccaaacgttaccttatcgataaattctacgaccaagaattcgagggtatttactgggaattagactataccggtcaacccgtgcaaaccaaaaagcaaatctacgccttaggattcgctatctacggattaagcgagtacaaccgggctaccggagataaagaagcgttggattatgcgatccgtctcttcaaggcaatcgaacaatatagtttcgacccggaaaagaacggttatatggaagcctttacgaaagactggaaactgatagaggatatgcgactaagcgacaaggatgagaatgagaaaaaaactatgaacacccatctgcatatcctcgaaccttatactaacttgtatcgggtatggaaagacgagcacctcaaaaaacaactccgaaacttgatcctgattttcaccgacaagattctggatcaccgtacctatcatttaaacctctttttcaacgaggattgggaaagcaaataccgtatcatctcctatggtcatgatatagaggcatcttggttactgcatgaggccgctatcgaattgggagacaacgagattcttcagaaagtagagcccttggttcaaaaggtagcgatagcggccgaagacgggttattagcgaacggtagcctcatttacgagtatcacccgaatgagaagaaagccgacacggacctgcattggtgggtgcaagccgagaatgtagtgggtcatttcaacttgtatcaacatttcggagatgagcctgccttaggcacagcctatacatgctggaaattcattcagcgttatttgatcgacaaggaacaaggggaatggcattggagcgtatcgctcgatcacgagatcaatcgcgaggatgacaaggccggtttctggaaatgtccctatcacaacggacggatgtgtatggagattatcgaacgacttgccggcgaataaccgtccggcagaccgcctgccggctcttttttatcagattaacaaccgtcggaagcttccgacatcaaaaaaacaagcgatatgaacaaattctattggatggtgataggcctccttctcggtttggtgaacctccgggccgagatcaagctgccagctttggtaagcgacaacatggtactccaacaagccactaaagtacggctctggggaaatgcaaccccaaattcaagcctgaaagtccgtagttcttgggacaatacggaatacacggcccaagtaaacgatcaaggcagatgggaaatctgggttcagacgccctcggccagtttcgaaaagcaacagttaacattaaagaatggacaagacaagattgtcttgcatgatcttctgatcggcgaggtatggttcggttccggccaatccaatatggaaatgccattaagaggtttctggcactgccctatcgagggaggaaaccacgctatcgctacatccgggaaatataagaactcgatccgttacgctacgatccaacgggtcggagccttggaaccgaaagattatccggtaggtggcgaatggaaagtatgtgatccgcgaaacgccccggagttcggagctaccgcctatttcttcgcgaccctattgaccgaggtattgaatgtcccggtaggtatcatcaattgtagctggggcggttccacggttgaaggttggttgcccaaagacatcctgcggaattatagcgatatcgatctatccttagcgggtaacgatgagaaaatccatccgatgctacaacccatgatcatgtataacggaatgctgaaaccggccagcaaatatacggtcagaggtttcctatggtatcaaggagagtcaaatgtcggacacccggactacgctaaacgcctagcgacaatggtagaacattggagaggattatggggacaagaagaattacctttctatctggtagaaatcgccccttacgaatatggagaaggagaccaagccgcgtaccttcgtgaagagcaatacaaagctacccggttgatccccaatagcggtattgtttccacgaacgatctggtacaggattacgagaaacggcaaatacaccccaaagaaaaacaaaagatcggtgagcgtctttgttatatggctctaaacaaaacctatggttatacaaccatcgcttgtgagggcccccaatacgatcatatggaagtagataaagataaaatcattctttttttcaagaatgcggaagatggcttcaatcgagataacgggatcataggcttcgagatagccggaaaagacatgcgtttccacaaggctaacgcaactatagacgctaacaaaaaaaccgttattatctcagctccagacgtaaaagccccaatagccgttcgttatggcttccggaatttccaaattggcaacttgcaaaacgtacaaggattaccggtgcttccattccgcacggataaataaaacgactaagaaaataaaatacaatacgttataatattcaagcttgttcacacgtaatgtcttattttcatctgtaagacgtatttagttttggtaattatatactactttacactatcactaaaataataaaaggacacataaccatgtatccttttattattcaatcgtttttctcatttttctttccctttccttcttttttaacgctccaagaaagagttttccgaaaaagaggatcacggggatctatttttggattatagccgaatatgttatcggctattctcttcatctccttctcaatatctttatgtattactacttctatgtctttcttttttctcatgctgccatattctttaactgtgaataccttaatcggtgtccgatattctgcaaaagtacatcgaatctttcacattcggaaagatgtttggtattatacctaaaagctgatgagtccacgtatctttgcagatgtttcctagacacccaatgatggacacccttcaatgttctttttaggtgtccccagaatccttcgatcgtattagtatgtctattcccaatgacgtaagcgcctttcttatgatagactacaccgtgatcgtataagttcttatccaaatccttataggcataccattcatcagagaagatggtagaccccggacatacaacatcattgatgatcgggatcaaggttccggctttcgtatcgttaacaaccttagctataacaaagccttctcgttgcagcataccaaataccggaactttgtccttacaactcctgcctcttgcgtttcttaccttcttactactatgcctattcttattcaatccccctatataagtctcatctacctcaacctctccgtttagacattgactggcatctatattgaaacaattctggatacgttgcaacataaaccaagccgtcttttgtgttatgttaatgaacttagccaactgaacggaagagacacccttcttagcgtttatgacgatatagcaagccaacatccatttcctcaacgacactttcgtgttctcgaagatcgtgtttgtccggacgttgaaatacttccccgtattcttgcacttgtatcggtttcccttgcatttataaacctttgagtctggatcgtacggagacacgacatgatcaccccatctctgcctctccaaaaaatcaatacatgattgctcggtagggaagaacttcactaactcatcaatagatttaaaatgattcatctcaaacataacactctgatttttaccctataaagataataaattcgttccaaaccagcaatcaaaccatagtctaacataatctagttaaagttgttttagttttaattaggattgtttagaaataagattgctatatttgaaaataaactttaaaatctaatgttatggaaaataaagaattaagctatattatgattgatcgaaccgagaatgctattgatgttgaccctaatagtttgttagacaatttgttttatgactataaattaaaaccgggtaatattattgaggtatctattaagatacatgataatatacgctataaatcaattgttattacaggactatttgaaataaaaaatcaaatactagaagagaatactcatcttttaatagcgaaaattatatacaacttctttgttgaagaagttggtaaaattgaaactgaaagggaatccccatttataggtaaagtatcagaagatgaggtttacagtaatattaaaaacaataaaaactaggttcttagatgacgaggcattctacctactccacaaagtttaccatcctctgatttgacaatctttattccattaatggaatggtaaatgtttcttgtaggatcatttaaaaattctttaaaatttgccaattcttcatctaataaaaaaaattcttttttgcaaagtccaatgtccatatttgcggtttttaaaaagttaataaatataataaaacaaaagcgggactagcctaaatctaatcccgcttatcttttaattttactgtttagtctacttatccattattctgaatagctcgaatgagtaagtatcctcatgtgttaagccgtgtccagcgtcccagatcccgtgatgtgttaggatcatataagattttcctttcatttccacggtccactctgagtatattgcattatcaaactccttatcaaaaactatactcatcgtatttggatcaaattcatatgtgaatccatctacgctaacagtattgtttcttctatcagttgttttttcatacccagtcccgtcttcaaagaacgcatataccatttgttctttgcctgcttctcgaagccacattcctacgatagaggtattatcgccaactacattttcgacactaaaacgatcgtcatcgtggcaagaaataagtaggaaacatgatatcgctaataagtatatgatacgtttcatgattactctccttttgatattacgcaaaatagtattacgatagatttatttttacaatattaatatttatcaatatttacaattagaactcaatacctatcttgaaattaaatccgtctatactcttactagaagaatgccctctaaaagaatatctcctagcttgtgacccataacctagggaaaaattaacagctgattgttttccaagcatatattttacaccgacaaagggattacagtaaaaaccatttccaccataatcgctagtgacatcaatggcataaccaatccttaatcctataaaaggaactatctgcccattggtaaagttccctcgtaaatctgcgaaaacgggaattaacgctgattcactatcagtgaaatatgatactcctgttcccgcaccgaagaagaaatacggatttaattggtatccgtgagatgtggtaaattggatacatccatcatcccccgtagtatatcccaaatccaaaaatcctcgataccctttaatatcataagtcctcttagggcctaatattttcttaaacgaataagatgtatcctcttctttccctaatttttctatctcatccatttgatagacaaagatactttcgtctctggtctgtacttttatggatttgtttggtacttgctctatgataagacctctgattacactcccgttctttagataaacaacatcttgtgttctcccctgtgaataggagtaggaaacaactaaaaataaaaaggctatcgcatatagtatttttctcatcttaccttggtgaatttagtttgtgaattatattcttctgtgttaatatatatttccgtagatgatattttggatatctctacaaaaatcttgttctcaacccccatctgggttatacttaatacgactttgtaattattattacctcgtagttcctcatacaattttacatctcctaagggtggattggattgattgtaaaatgcggcactttcttgggcatgcttaacgaaattcatagaagcgccatctaatccatatattatattgtctttagtacattgaaatgttaacattcctagtccatcaccatttttccatgtacctatcaaccaatccggtggagagagtttaaactctgtttgcgaagtgtttttatctccattttcccaatcctcatttccatcatctccgcatgatgaaaatataagcattatgtacatcaataagaaatacataaatctcacttttgttaccataaatctattgcttttatcctccctgtccccttcgttcggtggtttctaaataaaagaagcgtggggactattggatgttaccgtatttgaggctctggactgcccaccacccgataacaaacaacagccccacgccttatgattgtatatagtttgcccctagaggtataaatataacaacataggcgtaggaggcatctttgtctattatcccgagtggttgaaattgtccagatttcaaatacgagataatatcttaacgcttctacgtctttattctaatacgtggggcaaagatatagatatttagaaacgcaaacaaccctatgacatactttttaatgctttatcataggggcgatcaataaaaatgagatttgtctatctttttatagggaggtgtaaactggtatataattaccttagtttttatttcattctattgtgataatagaaattaccctcctaaagtattagtgaacttaattcttcccataaaaaaatgggagatcttattttacaaggaatcagagacctcctctgattcctatttatttttcattcatatcataatgtatacaaaaaatgatagtttgtatacagaccatactaatacattgcgctttttttgcatctagatttactgaagggggaaatatttgtatgacaaactaaataacaataattttatgaacaagcttattaacagaatttctccggaaacatctgaaaaccgaatcttacacgctggctttagtatcatattgatgtcagaggaaataacacaaaccctatctggtttatccagcgatatgattatttttatcttaagcggatccataactatatattccactaaagaagaaaagaaaacaatcggtgaacagtatatgatctttctaagatcatttgaaaattacacatatgatatcacactaggttcaaaaatcatcattttcttttttgacagtttaacgatgaatgagttaccgtattaccaacatccgtacggaatattacctcaacctatctctaagtggatagaactgaaaatagtggaacctttatacggttttctagaacttgtcggacaatatcttgaaaataatttcctgaactaccctttgtatgaattaaagagaacggaattattctacttactgaaaaagctttatagaaaagaggaattagactactttttctatttatcaagtacgcattcagcagagtttgagagactcatcgccgagaattatataaaagctaaaacagtaacagatctagctcaaatgataggttacggagtaaattcctttcggatgaagtttaaaaaagttttcggtattccagcctacgaatggctgatgcaagagaaatccaaacgactattggtcgccatagctaacagcgaggatgattttaagaatataatagatgaattcgatttctcctcgcattcgcatttctacaaattttgcaaggcacgctttggatatagtcccacggagctaaggaaaaaacttaaatcgttgtaaaaaacaccccctatcagaatatacatttaaattgtcaagttgtataactcctaataagttatactcatttatctttgcctcattgattttagacacctatccgtatggatgatctaataaaagatagtgtataatgaccaccatatttttttatgttttactattccaaattaaagactgggataaaatttgtgaagaagagggtaaaatgacatcgccgataatttgctatattttgctaggggttatcttattcataatcttgatgcgtatactttccatattgcagtttttgcgattgaagcggaaggtaaagaaacgtatttccccgaaacacgataaaccttcctgtaaataaagcctctacccgcttacattcattaataattaacggaagaaccaattcgcttctttctatgtttatataaaaaaagcgtttagatcatgggcttcaacattccttacacagacaaaaagcgggtcgtaattatcgggggcggatttggggggttaaaactagctgagaaattgaaaaagagcaagtttcaagtagtcttaatcgacaagaacaactatcaccagtttcctcccctgctttatcaagtagcgtcctccggcttagaatataatgaaatatcctttccatatcgaaagatattccagaagagaaagaacttttacttccggttggcagaggtctatggcgtcaatccgaaagggcataccattcaaacctccatcggcgaattggaatatgattatcttgtaatcgccgctggaactatcaccaacttctttggaaacaaaacgatcgaggaacagtctctacccatgaaaacggtagaagaggcgttagctttacgagacaccttattaattaatttagagaaagcgactacttgtacggacccggacgagaagcaagctttgctaaatatagttgttgtaggtggaggggctacaggtgtagaagtatccggcgccttatccgagatgaaacggtttgttttgccgaaagactatccggatctaggaaactttcatatgaatatctatctgatagaagggtcctctaaattactaggggccatgtctccggaagcctcctccaacgctaaacgcttccttgaggatatgggcgttaacatcattcttcagaagcgtgtcgtggactataaggatgggaacgttttcttagatgacggccaaaccatacccactagaaccttactttgggtaagtggtgtgaaagcggtgcatttcgatcatatcgaaggagaactcttgacccggggggaacggattatcgtcaatgaatgtaatcaagtaaaaggcttatccaatatattcgccataggagatgtctgctggatggcagaaccggattacccgaacggacatccgcaagtcgctcaggtagcgattcagcaaggtgagttattagccgaaaatctacaacggatcgaggctctaaaaaaaccgagacctttccattataagaatttaggaactttagctactgtcggcaggaataaagcggttgccgatttaaataaggtgaaattacatggatttacggcatggttggtttggatgctcgtacatttacgttccatcttaggaatcaagaataagctaattgtactgatcgactggatctggaattatttcacgtacgaccgttccatgcgtttcatcttgttcatccaaaagcacaaacaagatggaacacagggcacggaacctactttataaactataagtcaacgtaagccaagctacccgggcatcacgattgcgcttttgcgtcatttctaagttcggggcatcaataatcgttgtttcttctaaactatcgaatatattgttgatacttaagttcgcgcataatttacgattgaggaaatattgagagagaccggcatttacgctataacggcctttgatcttaccttgaggcgtaagctggtcggaaacgtagaagccgtctacctgaaaatccgtagtcggcgtaatacttacgtttacattccccttcacatcccagcaaaccaaggatttcttctcgtcatagcctatcgtacgcccatcgatctcgtcccgatagatatccccggagaaaccgaccgtcaagatacgtaccggattccagctaccggacaagtcggctccgactgcttggctatgtccgatattctctttcttccaaaccgtctcgtcatttacttggctagcggtttccatgatacgattcgtacgattccggtaataaatagccggagtcaaacggagacggggagccgagaactgatatcctagctctacgttatggataaactcatccttcaagtccggattcccctgtatgatatgggtaggatcactgttattcaagaaagagcacaaatagctgccattcggacgaatcgcccgttgctgataactcaagcttaagcgattgctcttattcacctcataagtaaaacgggaacgaggatacaaatgaaaacgggaactcttgttctctttgccttttatcccctgccaataaggatcgttgatccaagaagggctaaactcatccatcttaaaatgactaaattccgcctgtatccctatctctgcgttaaaagcgccccaattcttaaccacgtccgcatagatcaaattcagataacggttgaaatcgtaattatacgatttcgccggacttaactcaaaactaccgtcaaccttatcaaaagcagccgtcagataatcctcgtttcgcacacgacctatataaccaagcttgaaatcccaaccatcgatctcctgcccatatccaaatccccagaaataattatgtttcgtatggtcgatagattggttatcctccgagacgatattcccgttttgaggattctcattcttgaaatcattatcctcatcatacgagaaattattatagttgaatacggtataaaaaccttgattctccgaaatctcatggttccaatacgcttcggcggcataagcttcctggcgctggtcgttataccggttacggatcacgtacttcatttgctcccctttcgggttgaatacccggttgttaatgcgtccataccggctataatccatcaaatgatacaggccatgcacggtgatccggtctttcgcggaaagatcatagtctactttcatatccgccacatgtacgtccggacgagccgtggcattattattcatctccgtccggtttttagcggtcgcggtcgatttgctgaaagatcgttcccggtattccctcctataattgtatttcgcattgatatggaattttccgggatgcaaattcaataccgctcctgcgttatatcgctcattccatcccgccccaagcgtaacatatagaggggaatctcccgttccatacatacgaggcaccagattgagtatgcccgcgtcaccatccggcaccgcattaatcggaggaaatgcccctaatgagatctggttaaagaacagggcgggaagttggatcagcacgtcaccgctatattcttccagcaaaccgtaaggaactccatcgacaagcatcccgacattaccggagcccctgtatgtaacggctccttccatatcggttatgacagaaggcaattggcgaaaagcatccgccgccgtattggtaacgctactcaagttattatctacccgcaagattttcatcccacccctctcgctcaacccggcgaaacgggtaccctgaatctctatattccgaatcgtaagcgtcgtatcggcaggagtctgcgagaataccggcatagccaatagagcggccaatggaagaagtaaaatttgtctcatatcattatctatggtttataaacaaaaaaagtctgtatgttcaacgcatacagactgtcctcaaaactcgtttactgattattattcagcaggagcagcttctacggcaacagagtcagtaacctcaacagctacagaatcagtagcggcagcatcctcttctactacaggagcttcctcaactacagtagcctcttctgtttcagcaacagattcggtagattcagcagatttgttgccacaagatgcgaatgatacagctgcgataacagcagcaaatgcaactaactttttcattttgttcttaatttaaacggtctataatatcttgttgttgtaaaacgatgcaaatgtatgtattaatcatatatgttgtacaacataagacgtttttttttgaattattttctaccgcttttacaatatgctgaatattagctgcgtttgctttctatttatttatcaataattactgtacaggtaacgcttaatacttttcttcggtgttttctcaaattctgtcggatacaattgtatctccgagatcgtttcgtaaggagccaagagcttgttcaactctatcctattttgttccatgataactggaagatccgtatgcgagatacccgtactatccaccgtatcgtaatccggatacaccatcccgatcaatttcccgtttttctccacgaccaaactctccatcacgaatggcaaattgttcaatttggattcaatctcttccggataaatattttgtccgctagcgcccaagatcatcgtcttgctacgtccacgtataaaaatacggttgtcatgatcgatcgtacccaaatcacccgtccttagccagccatcttccgtgaagacattttgggttgcctcatcattcttataatagcctttcattacgttctcgcccgatacttgaatctcgcctaccttattataagggtcttccgaatcgatacggactttcatgatccctttcaagatctgtccgcaagaaccgggcacatactcattattatggtcataactgatcaacgggccacattccgtcataccataaccgatcgtgaacgggaatttgatcttatacaagaaatccgttacttcttgattcatggcggcgccccccacgatcacttcacggaaacgtcctcccaaggcatccaccaaatgtttgcggatctgcgcatagatacgtgaatccaacagtgggatattcaaggccaacttcaaggttcgcttattcaactgaggaaggatcatcttcttatagatcttctccaaaatcaggggaaccatcaagatcaagttcggcttcacctcctcgaatgcctttaataagatcttaggagacggcaccttacctaataaatagacatgcacaccgaatgccatgggtaccaataaattgaaagcgcaactataggcatgggccagaggcaggaaacataactcacgttcaccccggaacaatagatccagtgtccgggcatacgtcacgtttccggctaaattattccccgtcaacataacccctttgctaaatccggtcgtacccgatgtatagttgatctctaccaccttgtcattatccagctcagcgtatttgatatcctcttgggtgaagccatccggatatttctcggtcatcttctcatccagcgatttcatcaacttctggatattctccccatcccgttgatgcaagcaacgataatcagaaagagagaatacaccgcgaacctcttcgatcttatcttcctccaaagaatcccaaatccggtcgctaacaaacaaaaagacagattccgagtggttaataatatgatgtacatcattcggattaaagtcctgaagaataggcacgataatcgccccataagtaacaaccgccatataagcgatgcaccaacgggagctgtctttaccgatcaacgcgatcttgtctccacgacggacttggcactcatggaataaaagatgaatacgtgcgatctccgtcgccacatcaccgaaagtaaaggtcttacctttcccgtaatccgttaatgccggcaaggcccagttttccttgaaactctcctcgtaaatcttaatgaaattctctttgatcatagcacacttttgtgaaattcgcgtaaaagtaaaaacaaatccttacttttgccatgatataacctataaatttaaaataagaatgaaaagaatcactctcgcatgggcattgaccctctgtagttttattacatttatcgcctgttcatccccagatgttggagaaagaagcgtaagcattatccccgctccggcccaaatgacagtaggcgaaggtacattcacgatccatcccggcatcgagatcggttatgcggacgaatccttaaagggtatgggcgagttgctatccaacgagatagaaaagctatccggcatcaagctggcttccgcctcagacaaagaatcgaattgcatcatcttcctcgagttgacagatccgaaagagttcgccgacctgccaaaagcttatggattgagtccgaaagatagtgtccccgtagatgagtcttactccctctccatccaaaagagaaacatctacatcaaggccactaccctagaaggtatctatcgaggtatcactaccttgaaacaaatcgtgggtggtaatctacaacccggaggcgagaagatttatctaccgctactggaagtgaaggactcacctcgtttcgcttggcgtgggctttctttcgatgtatctcgttgcttcttcgatcccgaggaagtgaaacaagtgatcgatatgatcgccttatataagatgaacgtactgcatatgcatctttccgataaccaaggctggcgtatcgagatcaagaaatatcccgagctagcggaaataggaggtcaacttcccaacaacgggagaaaaggaggctattatacgcaagaggaattcaaggatctcgttaattacgcgaacgaacgcttcatcacgatcatcccggaagtagatatcccggggcatacagctgccatattcgccgcttatccggactttaagaacgctgtcaaattcaagaccaatgttaacatcccgggacaggccttcaatgccctcgacgtagatgatccgaaagcgatgcaatttacggaggatgttatcgcggagctagccgctttagcacccggaaactacattcatatcggaggtgacgaggcgatcggcttaccccatgataagttcgtccgttttataaataagacacgggaaatcgtattgaagaatggaaagaaaatggtcggctggcaagaaaccgcccgtgcggatatctcggaaggcgatgtcatccagcactggatttatctgaagcaaaaaaacgaggactcttctaagaaaaaagataatatacctgccgaatataaagagatcatggccttattcgcagaattcatgaaagaggcaccaaaagatccgggtcttgggatatccaaaaaagcgaaagtgattctctcgccgagcggttacgtttatctggaccataaatatctggaaccaagcgcggactccacccaaaacgcggagcaagaacgtttaggtatggccgcctacgagaaacaaacgatccaagaaatgtacgactgggacccgatgaccttcaacccgactgtagagaatcctcaaaaagatgtagcgggtatagaagccgctatctggtgcgagacgatcaccaatttcagagatctgcaattcctgttaatgcctcgtttggcaggtgtcgccgaaaaaggttggtccaaagtagagaacacacattgggacgaatataaagtaagacttggtgcgcaagcccccttatgggaaaaggccgattggaactattttaaatcatccttagtggattggaaataacagtacaaaatcttcataatattacgaatatttcgaaacaaattaaatatctttgtcctatcaactttaggacaaagatatttttatgaataaatggcttattatatttgcgatattactaaccgcttgtaccggcacaagcgagaaatcagaggaatgtataacaattgacctagcaactgtttttgaccatcagcctcaagaagtagccttaaagaaatgggcgaaatccatccaattcatccctctgcaaacgaatgactcaatcttgatcaaatacatctcccgcattattaaacatggcgataagctattggtacagcatgataacagagcttccgttttcgacttggcaggaaaatatttatacgatatcggcaaacaaggaggaggtccggatgagtttagtcgtatatccggactagaacctcatgatcatcttatttatataaaagatagccccactcggataaagatatacgattggcaagggaaattccaccaaaccattcaaattccggataagaacatccggggattttatcccctccctaagacgaacgttatcctaggtcacgtacccaacctctctggcaacgcacccattcggttctatttttgccaagatatagtcatatcggatagcataccttactataaatcttatacagaacctcctttcgtcatgacatttacctatgagttccgtcctttcgacggaaataagattgccgcatttaaggagttgttctgcgatacgatatttaaagtttccaacgacatgaagctaactccttatgccgtcctcgatctaggtaaataccgaacacccgaggaactccgttataatatcacgatagacgatataaaaaacgacctgttcaggacaaagacaatccctgtcatacccgggcaaatcggagaccggctctatatgcataacttctctgataaagatacctatacattatattatgatatagcggagaagcaattagcctatgtacaattcatatacccggaaaactcatttgaacttcccgaagaagcctatttcactcccaaatacatctcaaacgacaaccgttacctaatcgactgggagcaacccgagaatgataacaatccggtattaatcttagtggaaccctagttgccgtatttcctctatcggcacaataaacaaaacaaggccgcagcaaggactattcgataacaagtcttcataaataatgttgcttgactgtatctattccttagttcacggcatggtttttacagaccacgtcatggtttatacagaccacgacgtgaatcgcacaaaccacgccgtggtttgtagaatatatccaatagcaaaaaagaatagataagcttccggaaaactatttatgcaatagtaaagagtttttaagtccatctcaatccgaactctttactaatccgggcttaattagtacctttgcactctaactaaatcgaaaatgatagatcagaccgtatttaacaataaaaaggccgcttattatacgctgggttgcaaactaaatttcgcggagacctctaccattggaaagctattagccgaacaaggggtacgcaaggtgcgccccggtgaaaaagcggatatatgcgtggtgaatacttgctccgtaacggaactagccgacaagaaatgccggcaagcgattcgccggatcggtaaacaacaccccggtgcctttatcgtggtgaccggttgctacgcacagttgaagccggaggaagtctcccatatagaaggcgttgacttggttcttggcgccgaacagaaattagagatccttcaatatctggagaacctagagaagaaagaaaatggtggagcggttatcgcctcacaaagcaaggatatacgttccttctccccttcctgctcggcggacgaccgtacccgtcatttcttgaaagtacaagacggatgcgattattattgctcttattgcaccatacccttcgcccgcggaagaagccggaacgggacgatcgccagcatggtggaacaggcgcaggaagtcgcacgtaaaggaggcaaggagatcgtattgacaggcgtgaatatcggggacttcggcaaaagtaccgacgagacctttatcgacttaatccgggctttggatgaggtagatggaatcgtacgctatcgtatctcttccatcgagccgaatctgattaccgacgaggcaatagacttcgtggctcacagcaaacgtttcgcacctcatttccatatccctttacaaagcggcagcgatgctgtcttgcaattaatgcgccgccgttacgacaccgcccttttccgtcataagatcgaaaagatcaaggaagtaatgccgcatgcctttatcggcgtagacgtaatcgttggaacccgtggcgagacagacgagtacttcgaggaggcacgccaattcataggcagtttggatataagccaacttcacgtgttcagctattcggaacgccccggaacccaagcgttgaagatcgatcacgtggtagatccgaagaccaagcatgcacgcagccaacaactcttggatatctcggatcggaaactacatgccttttatgaggcccatatcggacaggaagcgaatgtcttattcgagcataccaagaaagacggcaagatgcacggtttcaccgagaactatataaaggtagaaatcccttatgatgccaccttggtcaatgagacccgcaaagtcgtactaggcggctggaatgaggatcgcaccgcattaatagtcaacaatcaatcatcaaccgtcaactgagatgtgggataaaatacaatatgcctttctttatagctgggtaaaagtacacgccttacttcccatgcgggctttatacgtgttatcagacatcctatatgtccttatctataagatagccggataccgggtaaaagtagtgcgccgtaatataaccgcctctttcccggataaatccaaggctgagtggcgtcagttggaacgccggttctaccatcatttcgccgattatatcgtggaaacgattaaattggcccatatctctctggatgagatacaacagcgagcctatctgaagaacccggaattggttgaccaacttatggagaaaggccatacttgcttcatcctcacgatggggcattatggcaactgggaatggttctccggatcgaccacccgtttcgaggactcacgcatctatcagatataccgtccgttaaacaacaaggcctttgataagctattcgccgatctcaggacacagttcggttctttcggcatcaagaaaaacgatacgatacgggatatcatcaagttaaaacaagacaaaaccaaatcagtcgtcatcttcttggcggaccagacacccagcaaggccaacctgcattattggaccgagttccttcatcaagatacagccatattaaccggtccggagcgtatcgcacggaaactgaacctgcctgtgatcttcctcgatacccaaaaggtaaaaagaggatattacaccgtagacatgaagctgattacggagaatccaaaagagactccggagaattacatcaccgagcgatacgcacgacttttagagaaaatgatcttgcgtgatccggcttactggctatggacccataaacgttggaaacataaacacgagcaacaaggatgaaaaaagtagcgattgtcatcttaaactggaacggaagaaagctaatggaggaattccttccttccgtcgtatccaactctccggaatgggcggaggttatcgtagcagacaacggttctaccgatgactcgatcaagatgttgaaagcaaaattccccacggtcagcattatctgcctcgaccagaactacggatttgccgaaggatataatcaagcgctcaaaaggctcgaccatgaatattgcgttttattaaacagcgacgtagaagttactcccaattggttagatgccccgatttccactctcgactctgatccgtcaatcgcttgtgtccaacccaaaatacgggctcaacgaaataaagaatacttcgagtacgcaggtgcggccggaggatacattgataaatacggctatccattttgtcgggggagaatcttgcatatcgtggaaaaggacgagggacaatacgacactcccgccgatatcttatgggcgacaggagcctgcttattcgttcgcacggctacgtataaggaagtcgggggattggatgccggattcttcgcacatcaagaggaggtcgatatgtgttggcgtttacgttcccggggatatcggttgatatgcgtcccacaatccatcgtttaccatgtcggtggagccaccttgaacgcggaaagtccccgcaagactttcttgaatttccgaaacagcttattgatgctttacaagaattcccgggaagaagatctaaagcatgtgatgtgtgtccgcttttggctagactatatcgccgccgcaaagttcctgctggaaggacatttcgcgaacgccaaagctgtttatgaggcacggaaagcctatcaccaactcaaaccggaatatacgcctaagcgtaaagagaatctggagaaaagaacactgagcaccatcccggaacttatgcgggacagtttaattctggcattttatctaaaagggaagaggacattcaaagtgataaaggatagacgataaagaaaccggccttcttacttcccctaaggagaaaagaagaccggttcgcaaaaaatatataagattttaagtatcaatccctgtaaaatggatatcaaaaaaccacccgataaaaaaagaaatcccgggagagagccaaagccaatgaataagacaggtcaagtctctgcaacttcaaaatggtcttttcactaacggcacgtttcgatgtcttggcgatcccggtatatacctcatgaaaaggaaaagcttgctccacaagttgctcttgtacagctttattataagcggcacgcaagattctcatataaaatgagctactattcttactcactctccttccccatagccatttctcatatttgcaagccgtatcggagtctaatgcggtgagaggtatatcacaattctctaaaaaagaggaaaagctgttcaatattcgtaaataattacgggaagtactgaattgaccgctatcatgaaggagtccaatctcttttctcaaatagtccaacattccggtttcagtttttggagatcggcaactaacacttaattatttcgacgatattcggttggagtgaccccatagctttgtttaaaagccgtactaaaataacgagcgctggaaaaaccgacacggtccgctacttcctgaatactcatatccttatgagatgaaagcaaccgagaagcctcgaccatacgaaaccgaatcacataatcaccaaccgagacatccgacaaatgactgaacttgctataaagcgtcgttctactcatcgccatcgcagaggcgataaaaggcacattcaaatccggattactcaagttctcccgaagcaacgtattcaatttacacatgaattgttcgtccgcattgcttgtcgcatcctcttttggagagaatagacaaccggactcacgataacgcacacgaagtaggtctcgttgtcttaatatattccgcagaatcaccaacaaggaatctatatcaaacggcttcgccaaatagatatccgcccctgatttatccccctctaccgagcttgcttgatccacccttgcggtcaacagaaccacaggaatatggctaaccgctacgtcgttcttgattcggtaacacagctcaaaaccatcagtccgaggcatcatgacatcactgattacaatatccggctgacattgacccaagatttcccaagcctcttccccgtctccggctacaaaaacctccttaaactctgcctgcaagacaccgagtaagtagttacgcagctctatctcatcttcaaccaccaacaatgtatatttagcaagctccgtatctacctgtaccccgcacacatctgtttccggcttgtcagtgcccttcacgcttaaatcgataacgctatccggttccgcggcagcaaacgcttgcgtgaaaggaaggtcgaaatagaaagtggcacctacatcctcattattgtaagcacctatacttccgccatgcaactctataagtttccgggcataagccaacccgatcccactccctttacggtcgtgttcaccttggtaaaaacaggtaaaaagacggtttatatccacatgtctcaatccgattccctggtccgcaaggaaaacccgcacattcttatccatacgctccgtaccaatgactaatgaggtatccggatcgctgaatttcatcgcatttatcaataaattagataaaacgacacggcatttggaagtatcaaagggtactttctctaccgaagcatccaactggaaccgcacagaaatcctacgggcttcgaattccatgataaaatcatccgttaccgatcgtatccaatcgttaagatcgtaaaaacgaatatccataacatcgccgttcgtatcagacttctgggcatcgagcaccatatcgacgatctcccgcatccggcaagtctgcaacaacaaaccatccaattgccgggatacatctttatccgtcacctttccggatttcagcaaacgtttgagcggagcatagatcaaagtaagcggcgtacgtaattcatggctgatgttcaccatgaaacggactttttcctcataaaactttcgttcatgttctttcatggcccaagcaagtttccgttctttgcgtcgcataacagaccagatcatccctccaattgccgcaaacgcgatcacccccatcgcgatcagaaaccaagcgcgtctccacaaaggaggctccacatctaccgtcaataatctcaaaggaacactccagtctccattcttcttgctataggaaacccataattcatagttgcccggagaaagcgccggaaatgtaaacgcatggcttgaagtctccaacaactcctcacggtctcccttgatgtaaaaacggaataatttcttccgcatcaaatccttctctttcacgataacacttaacccaagggaaacataatcccacggaatggaaatagcctgttccccggatataccatcaggatgaatcggtaacccatctaaagccaaattaatcatgctcacagaaaaatcctcttcctcatgaatgtcatagccgggccgtatcctaaccagcccttccactccagaaatataaatattaccggaagaagactcaaaagcaggttccggaaagtaccacgatcgaaatatgccaatccgcaactggttcctaccccaatatttccctccgcatcttcctccaaaaaaactatatcattataaggaagagaatgcggattctccctctcctcctgataaacggtaatcttttccctatcgaaacgattcaacccaaatcgggtaccaatccacataacccctctttcatctaccagcacacattttacggaagactgcgataatccgttttccaaagaaatttgtttaaaataatacctaggagctgcataaagagactctgttaaacacactaaaaacagcaatagatataattgtaaaaacttccaaaatactcgcatagttgtatatcacccattgttcggcaaaaacactaaatcgtccgaaatataaggcttgcagagtataaaaaaacgttttttgaattttcacggacgattttggactcaagaaaatatccttaaagcatagatttgcagcaagtgaaaaattaaacaaaaaagcatatcattaaaaattattcttatgttacgtacaacgggtatatattttattattttggttatgatacttgtaaaatgtttccttccggacgaaaaaccggagatcattcctttccccttgcaaagtgtatcagacaaaggtgatttcacattcaacaaggcaaccctcatcagtgtagaaaatgaaaaacaggctatgatcgctcgggagttgaccgatctgttcacgctttccgccggattcaccccggaaataaaaatacaagacaaacgagccaatatcatattccgcacagacagagaactagcggccgaacattataaactgaatatagccccctcttgtattctaataaaagcatccggacaaaaaggtttcttttacgcaacgcaaaccttacgttttctgcttcctccagcaataaacagcccaactcaggtagagatattcaatggaacgtaccgggaatgaccatactagatggcccccgatacagcaatcggaccgtggcaatacacacacctttcactctcatctcgaaggataatctcaaagaattaatcgatcacctagccatgttaaaaataaacagacttcatttcacacaagaagttcatgatacgacacctgaaggacagcaaaaaatgaaggatatgaacctgtatgctaaatccaagaagatcacgatctcaaacggaacaacacacacccatgatatcatatcgtatctcccgttccaagcagagctacttatctggaaagcaaatatctccgattgcgatgaggataaaaaaggttattccaatatttagcgcccatcgcagaaagaagctggtctggtaatttgttagcccatcgcctcacgcaagatatcgatcaagataggcttcaatccgcttacgaaacattccacggcgatcaccatcagtatcaatcccatcaaacgcatcatcacgttatttccagtctctcccaatatccgtaccaaacgggtagaagcttgtaagatcaagaacgtgataaaataaaccaatgcgataataccaatcaacgtaccctttaagctgagtgtcgaggcgtcatccataagcatgattgcgttggcgatcgctcccggaccgcacaacatcgggattgccagaggagtaatggatatatcatccgcataggttttcacctcttcctctttcaacttcgcgttcgagtagcgtgcttgaagcatatcaaacccaatcttgaagataataaagccgccagctatgcgaaagccgttcgaggagataccaaagaacttaaacaggaactgaccggagaaagtaaaaaccatcaaggtgatgaacgacacgatcgtggcccttcggacaatcgctttccgctcatggtcattcataccattggtcatggtcaagaaaaccggcatcgtaccgagtggattggtcaacgtaaaaaacgaagtgaaacataatagggcgaaaggtaacaagtcttccatatcaataattttttaattggctaatgtgccaatatgccaattagttgaagagagcatgattggcacattggtacataacatattatcacattatttactcatcccagaccaaataggctgagaccaaccaatgattcagcttattcccatccacttctgccgcttccggaatactcaccgtcagcgtatgatggccgggttggatatccttcagctccacctcttccggtatcacgtccgatccgggacaccaattagagcgggaaagatccgaagacgccaagggttcctctacttctttctccgaataacccttctcggtgatataggcagccagacgctttctcaaccaaaccccggtagccggattaaaacgacggaaagaagcgcagtccgtacgccaaggaacaaaatccaagacaggaactccatcaacagatacaatattctgtttctccacgaactcatcaccaccggaatgaccgccatgtcccgtaacgatatatttcagacggacatcacgtgcgccttgaggaatatcaaaatccaatgacacgtccttccgggcgaatatatccggatattcctgcccgatataataaaccgtattcatcaacggctctacatgtttcttcggcaaagcgtcgcaagtcagatcggactcgtccacatcgatcgtcatgctagcgacgtatccttccagtgtccatgtatcgataaagatcccaacataagcgccaccttccagaagaggatacaaatcggttatgtcttgctcccagcttacgctatcctcccaatggtcgacatacacaggtttacgatgtttcgtcaagctatcctcgggactactgtaatgccctactccgaacggagtcatgaaacgcatcaattccacggtaggttgataatccgtcccggggatgataccgatcatcttctccagtttcacgctatccaccgcaggaaactccttctcgcctttagcgatattcaacaaattaatgcccgaggcatttggcaatacaaaacaagagccggatttatcccagcgatctccattcgaagctaccgtaacccggagtttgacggaaacgtttcgcttatattccggcaatgttaccttcttcaagataatacggccattcaccaaatgatagatactgtccggtcccggagcgttaaaagcggcgggatatacatccggagcgaaacgtacgtgggtttcattaaatacccgtacggaataatctcccattgacggtaattctttatgtccgcaagaagcggtacatagaaaaactcccgtcaaggagacaaataaaaccaattttttaatcattttgtctagaatttagtaagctccttaataagctgcttttgtccggcagtcttatcggcgtgcgtacaaggaccggtcacacaaccgccctcgcaagccatcacttctataaactgcgcgggagcctttccggttttagcataagcacgtaataatgccacatttttctttgtcaggttggctacctgcacggcatttacgttctcgtccttcaaataaaccttaacggcgttgatcacaccaccactttgggcgaagccatgcgcctcacggacagcgttaaataatacagagaaaggctgggcctcctcgatcttgatacccaatccctccaatacggaacctacttcctcaaacgtaagtgtaaaatccacgcacggatctagtttcacctcttttcgtttcgccacgcacgggccaacaaacacgatcttcgcatccggatatttttccttcacgatacgggccgtataatacatcggagatccagtagaagagatgtatttctttaaatccgggatatgtttctcggccaattgcacgtaagacggacagcaactagtggtcatgaacggttgtccttctttcaatttctcgatcaattcttccgcctcatgacgggtggtttccatagcgccttgcgccacctcaaccacttcctcgaatcccaaggacttgatagcgccatacactttttccttcggagcgctaaactgagctaagatagacggagcgacaatcgctaccatctgttccttattccgcaagcgttgcaagatatcgaatacttgcgagatctcgaagatagcaccgaacggacaagcattcacacatttaccgcaatatatacatttagactcgtcgatatgctccaccccatactcgtccttgctgatcgccttaaccggacaaacttcctcgcaagggatcgggatataaacgatggcatggtacggacagctttggtggcatttaccacagctgatacaagtttcatgatcaatctcggcctgaccgtttttcttgaatcggatagcgtccttcgggcagttcatataacaactacgagccacgcaaccccggcaaagattcgtgatctcataattcacggagacacaagaggaacacgcctcatccactacacacatgatattttccttcttattctccgagcggaacaaggcacgcttcgcatactctgaaagcggtgtcaactcatcttcctcgtcctgcatatcaaaaccaagcaaaggcaaggtcttgtatttccagacggcacgttccttatgtacacagcaacggcccctcactttcgattttcggggactcaactcgatcggtaagcgatctatttcttctagaagacggttttctttccagagctttactaacttcgccagcaatccgtgacgaacaatcattacgttgttggtaaatgccataatgttatcgtatttgtgcttttagtatatcgtatatcgcatcacttctttacaaacgcgaaggtaaataaaagtttctaaacagaaagaaagctttctttaagaattatcgaagcactatgaatatctccgccaaacggaggatttaatttagacaagacaagttccacctccgtgatctgtggaaatctctctttcaaagccttcaagatacgccccgccgcgtgctcaagaagtctcgaggggatagccatttctgctttcacggtttcatatactgtggcgtaattgatcgtatcgcttaaatcgtcgctccataccgcattctccaacggcgctgtcagtatcaaatctacgataaaagtattcccaacccgggtctcttggggtgccacgccatgataggcatagaatgtcatccttcgtaattcaatctttgttgtcataatcttttaatttatctgtaaatgtatagaaagtaaaccttcctgcaaaaaaatagtcttatatttgtcaaccaagtaacaacacattatgatgggaataaaacaaaaagatgaaaattccgcaggcggattacacaacgccttggctgcggggacaacgataaagggtaatattatcacagagacagactttcgcttggatggaaaagtagaaggggacatcagttgcaacggcaagatcgttatcggccccaaaggtagcgtaacaggcaatatcgtatccgagaatgctgagattctcggtgaggtagatggctccgtaaaagtaagcgcaaagcttattctaaaatcaacagcaattatcaagggagatatatatacccaatccctagagatcgaaccaaacgcacggttcaacggagcctgctcgatgtgttccgagaaaaagaaagcggacaaatagactgagggccgcacttttcgatacggcccttagtctttcttattttcgtccagcctcttttatcaacgagactatcttattattcaggttatcagcctgcaaaagctgttccaacgtaatatgcatccggtagcgccaataatgcgttgaattcgcaggaacgttaatacgctcggattctatatcctttcgcttgatagaatcatccatagcaaaccaatcctgcaacggaataatcgtcagcatggaacgagtcttcaaatgattagaaataatctgggcaacgatttcagccgtacattcatccggggcctcaccgatccgttgcaatacatggttgtaataacgctgtgtcttctccggatcttctttccaccaattacgaagaggagtcatatcatgtgtagaagtcgtacaaacggaatgataaggcaaattaaacatatcggaaaattcccgctgcggactcttcggcatacgctcaatctcaaggcttagtatttgcaacttattcataacctcgggaacagaggcggggatcatacctagatcctctccacaaaccaacatctccgtggacgcgaccaacggtgtcaaacgcttaaacgcttgcgccttccaaaaatcattatggcgatgatagaagaaatgccagtataactgatcgaacgcataacggtcggaaccactcaattcccgatagatataggattgattcgccgagatccggggatggaacttatcggtctctcttgggtcacgaagaaataatacctcattcgcaatcgtaaacaggccattcttgatccgtagggaaactggatccgccttatccgcaaacaacgcctcaatcttcctttgcgtatcacagaacggttttaacacataatgccgggaggaggattgtgccaaataagcacctatcacctcttctgtattttcctcaaacaattccgataaaaattgtcgattgatatgtggggtcgtgaaacgagattcgttaaaattcaatccatactgctcgatctcttctctcgagaacggcaacgctggattgaaatgaccacaaagcccttgcacatattcacaaggaacctcccatattcggaaaaatcccaagatgtgatctatacggaaacaatcgaaataatcacttaacttagcgaagcgttttttccaccaagagaaattatctttctccatcgcatcccagttataagtcgggaacagccagttctgaccgttcatggaaaagtcatcggggggagcacccgcttgaccattcatattaaaatatttcggttccgtccaagcctctacactagtgcggctcacgccaatgggtaaatcacctttcaatacaactccattcttacgggcataatccgataccgacttgaactggttgtgcaatacatattgcaagaaataagagaacgagatctccggccatgcgtcactatcttcccggcatagggcgcgaacacgtgtcttattgtaagtagaattaccttgccattgagagaaatccgatgtcccataactttcccgcaagaaacaataagtagcgtaaggcatcaaccatgactcattttgcgccaagaactctttaaactccggcgtatctaatacggccttaccctcccctgcgaaatattcttgacaataacccaatttatatttcagtacttcctcgtaatcaaccgtatcttttgcgtttaattctttttgcttccctgcataaaaagctgctctctccggatctttcaaggtccccaaagccgataaatccacatacatgggatgaagggcataaatagaaatagcgctatacggataggaatccacccaagtatgggtcattgtcgtatcattcataggtaatacttgaatgatacgttggtgcgtctttctagcccaatccaccaacatgtgtaaatctcccaaatcacctactccaaagctcttttccgagcgcaaggaaaagacggggataaccgagccggcacaacgccataacggtaagctatcccggaagtaaagaccagatataacaacggtctcaccctgtttctggggaacaagacttagaatacgattctcatcactctcccaatacaaaggttgacgggaatcattatcccaaaccaaaaatttatattctaaaggataccgtatctccgcagcgtctaaatcaatatgccattccgggaaagtatcgcaactcagcaataaagccttgtccggatgccagttacctaagcattcttgatttccagtaatggctacacactgattcttttccacccggggagcggatatctttatcaccaattttcttccacttctaacgaccctctcatgtgtattgcagggatgagcgaataaacttttggtgaaagccgaagaataaaaggctagattatccggacggatttgccaataatcataaaggatgtaagaatcagattgtccatccaatacaatccggtgattcttctcccactcctcaaagatctgcttatcattaacacttaagaaatatctatattctatatcttttatatcgggtggaagatccagttccagtttccagtttccatccccagagtaattcatctccttagccaaagcaggttcccaagagcctaattccggtatggagcccactacacataacttctgtccccaaacggtatggaagtttatattaaaagtgactttcatggtatatagatttagtcaattatttaaccgcatttagaggctccgcaattcgtgcagatcaaacaaccttcttgataaatcaaggtctccaacccacagttcggacatttctgccctttcgcttccatgccgttcggtaaatatttcttcaaggcccgttccacgccattcttccaagtattgatagactcgctattcaactccataccctgtaccagttttataacctgatcgataggcattccgtaacggagcacaccggaaatcaatttagcatagttccaatattccggattaaacttgccatccaagccttcgattgtcattttataaccgcgtttattcttgaactggaagtcgtaatgcttattaccatcctcatcatagctcttgatgatcgtacctttagaaacgtttttaggtaacatgataccctcgtcatcatcggccaaaccggtaaagatctcatacggacggccatttaacaagccgacgaaagcgatccatttctcacggttattctggaattttaccacatccgcatccaattcacgaggacgggtagatacgataaccggtggttgcatgcagttgcaatcctcttttttcttctttttatctgtcgcaatcaagacaccggaacgagaaccatctcgataaacagtacatcctttacatccgcatctccatgcctcaacatacaaagaatctaccaactcctcacttacatcgttcggcaaattgatcgttacgctgatagaatggtccacccatttctgaatgcgtccttgcatacggactttttgtaaccaatcgacatcattggaagtcgctttataataaggagacttagcaactagctcctccacttcttcttgtgtatatttcttacttgccgaataaccattcgcttgcatccacgttacaaacttatgatggaatacgatatactcctcgaaagcgtcgcctgtctcatccacgaaatccacacgagcctcggaatcgttcgggtttactttgcggcggcgcttatataccggcaagaataccggctctataccggaagtggtttgtgtcatcaagctagtcgttcctgtcggagcgattgttaagcaagcgatattacgacggccgtatttcaacatatcctcatataaagcaggatcagcctcacgcaaacggttgatgaacggatttttttcctcacgcttcgcatcgaatatctcaaaggcaccacgttctttcgccaacattacggatgaacgataagcggccaaagctaatgtcttttgtataagttccgcacaatcggttgcttcttctgttccataacgcaaacctaaagcggcaatcatatcgccttccgccgtaatgcccacacctgtacggcgtccttgcaaagtctttcgttggatcttttcccacaaatgacgctctgtttgtcttacctccatggattccggatccgagtcgatcttagccaagatcatctcgatcttctccgactccaaatcaataatatcatccataatccgctgggccaaacctacatgcttcttgaacaaatcataatcgaaataagcgtccggagtgaacggatttaccacatatgaatataaattgatcgctaacaaacggcaactatcatacggacaaagaggtatctcgccacaaggattcgtggaaaccgtacggaaccccagatccgcatagcagtctggtacagactcacgtaagatcgtgtcccagaatagcacacccggttcagcggatttccaagcgttatgaataatttttttccataagccagaagcatcgatatccttcacataaacgggagaatccgaatcaattggatattgttgcttataggtaccgccattaaccgcggcattcatgaaatcatcatcaatcttcacagatacatttgcacctgtaaccttaccttccgtcatcttagcgtcgataaacgcctccgagtccggatgtttaatagaaacgctcagcatcaaagctccacgacggccatcttgggccacctcacgggtggaattcgaataacgttccataaacggaaccaacccggtagaagtcaacgcagaattcttaaccggagaacctttcgggcgaatatgcgaaagatcatggcctacaccaccacggcgcttcattaattgtacctgttcttcgtcaatacgaataatcgcaccatacgaatccgcttgcccgtccaatccgataacaaaacaattagagagtgaggcaatttgataatcattgccaattcccgtcatcggacttccttgcggaacgatgtagcggaaatgatcaaacaggtcgaaaagttcttgttccgacaacggattcggatactttttttccacacgggcaatctcacttgccaagcgatgatgcatatcattcggagattcctcatagatatttccaaacgcatccttcaaggcatatttatttacccatactttagcggcgagctcgtcaccggtaaagtaatccaatgaagccttaaacgcttcgtcaaaagtgtaagttttacgatccacaattattatatttattttgcgactgcaagtttacgcatactttaccagttatccaaattaccctacgttaaaaagaatacttattgaaaagttttccaaaacaaaacttgcaactccacattttcaactacttaaacaaaactaagcatcaaatagttttccaaaaagaaaacttaacacttatacggatcttccaaaacaaagaaggacgcctctttagagagacgtccttatcctactatatagggattcttaatttagttcttgagcaagacctcgatttcctctacggaagaccggaaagacttactagtctcaatctggtctttgatcgtcttacaagcatgcaagaccgtcgcatggtctttctttcctacgatctttccaatatgggaaaaagaggagtccgtatatttcttcgccaaatacatcgtgatctgacgggcttgcacgatctcacgtttacgggaattagtctggataaccgattgctccaagttgaaatacttgcaaacgatctcctgaatcatctgtacggagatctgtttcttctccaaccgaaccgcttggctaaccacacgtttcgtcaacggcagatcgatctcacgattattgataaccgcattagccattaaagagacgagaataccttccaagtcacggacattctccgtcacattattagcgataaagttaaagacctcatccggaatcatgattccgtcatggttgatcttattcttcagtatctttttacgtagatccagatccggacggctcaactcagccgtcaatccccattttaaacgggtgatcaagcgctcttccatcccttgcaaatccacaggaggtttatcagaagtcaagataagctgcttacctaactggtgcaggtggttgaaaatatggaagaatgtattttgagtcttatccataccgatcaactcctgtatatcatccaacagcagcacatcgatattttgatagaaattcaagaagtcattagtcgtattcttacggatagcatctgtaaactgtacccggaacaaatgcgaagatacatataacactttcttttccggatgcaactcccggatacgggttccgatcgcatggcataagtgagttttacccactcctgacggaccaaaaataaacaacgggttaaacgtagtctttcccggattctgggcaacagcctcacccgccgtacgaaccagcttattgctcgtaccctcgaaataattatcaaaattatacttcgggttcaactgagggtccaaatcctgcggagcagtcgtcataaatggattcggagccttgttagcgtccttgggagtgactttctttacagcggtggaagcattctccgccggataatcaaccgtaccaccagttgtcttatccaccatgatacggtagttaagaatggttccttgaccgattacacgatacaatgtaactttcaaaacattaacatacttctcttccagatactcatagaagaattgactaggcacctgtatggtaaacttcttgtcttcgtatgataacggaacgataggtacgaaccatgtgtcaaaagctgccttaggcacaatatcctttatgaccgcaaggcacttattccacaatgtttgataatcagtctgcatgttttctttctctcccactaatactttttacattcggactacaaagtttagaaattaattccgaaaaaaaaagtgctattttgtttggtaaatatgaattttcaatatcccttttagattcagatagttactaatacctatctgatttactgctatttagatcgaccaatgttcaaaaaccctttattttagagacctctacaaaagcgtaaacgctgacgtccggtgacggaataaggcctcaggaagtatctatctcactttacctaaaggccttatacgtataatcagcaggagtcccctaactttttgtctaattagaatgattctaaataacgtcttttatgctatgattttttaacataatcaaaaaacagagaaatgcacgtatctcttcggattctcccgcaaatcaagcaatagcttagaggcgttgtccatcgtgctgttcagattatcatacaatcctttgtcgtttaacaacaagccgatgctattatccgtcgaattcaatttatccgtagtcaacttcaagttcgccaaggtcgcattgatggaattgaccgttgtagccaaatccaattctttcaagttggcgctcacctccgagaaattatccgtcatcgtcttcaagttattcacgatacccggtacatccttactcaacatctgattcaactgacgggtagacacctctaggttactagtcgttttttcgatatgattcaaggattgagccaaggccggatgagcgatcaaggtttgcaagctacccaagatcgtgtcgatcttcggcaaaaggttctcaacgcttggcaagatcttctcctgtacggattgcatcatatcctcttccattcgtccctcaagcgtagaacccggcttcaaaaagtcatccacgtaagtgttcaaatggatatgcaactcagctccgcttaagaaagtattgacaaccgctatataacttcccttattcagcctcatcttatcttccaaactaacctcaacgatgatcttaccggtcgtatcatagtcataaataatatcacgaaccaatcccaccttaaaaccatccacaaatacagggctggaaatcgtcaccccctttacgttgctgaatgatacgtagtaatggttcaccggttgaaacaggttaatacccttcagataattaatgcctaaatacaataacgccagacttacgatcgtcacaagtccgatcttcgcctctttagtgaatacacttttcatttcctttatttataatgtataatttattcctaaatcattaatatttcaccttcttcccatccttaaaagcgatgatgaaagcatctttaaaatcttttgcgatcgttcggcgcatcttccggatcgagttaaaatccgaagtctcgccatacgtgtatttatagatacctttctccacatagaaatccacgttcttgtaccccttaaataaccgggagttcgcaggaagcttcttattggaagtcaagaattgtatcttatatataacctttcctttcgtgttcctgttcacggaagtggtagaagaaactgagtttttctgtcttgtggcttgctgttttttatttaagatatcagcctcgctccccggaggcggagtttcctcattcgctacgggagcaacgacagctccggaaatatttcctttacgacgatcgtaattcttcttatatttgcaaaaagcatcgtacaacgcttccgccaatttattttgtccggcggcggttctcatgaactgctcttcttgacgattcgagatataccccaactcgaccagaacactgggcatgctcgttttacgaagcaccaaaaaaccagcctgtcttacgccacggtccacccgcttacaagccctgaacgatttctgtatctcggaagccaaactaatactttgctccatatgcttattctgcataaactcgaaaatgatatatgactccgaagagttcgggtcaaatccctcataccgttgttgataattatcctccaacaagatcgctgagttctcgctcatagccacctctaagttctcttcgctacgggccaaacccagcgtatacgtctccgtaccttgcacggtacttccacgctttacggcattcgtatggatagacacgaaaagatccgccttattgcggttcgctatattcgcacgttcgtccaactcgataaaacgatccgtcttacgagtatagatcacacgcacatcctccgcgtcattctctatcaatcgacccaattttaaggcgacagcgagatttatctccttctcattaatattcgcccctctagcgcccgggtccttaccgccatgcccggcatcgatcacgaccgtaaaagtcttctctctcgcctgaagtccgggcaagaaaaaaaacaacgcaaatagcaagttaatatatagaaaagactttttgctcactttctaaaattattgcaaatttggagacaaatgtagtgcttttttgctgattgacagatgtctttttttataattaaaacaaaaaaagagggtagtttcgaaactaccctctttcatgatatattaaagtatctattattcagaaacaacctcgaaaggaacctcaacggaaacctctttgtgaagtttcaaaatagccttatagctacctacttccttaacagactccttgatatagataatcttacgatcgatattctcaaaaccagccttagccaaagcctcagcaacttggatattcgttacagaaccgaagatcgtacctgtagagctagtcttagcaccaatcgtcaaagctacaccctctaacttagcggccaaagcctgagcgtcttccttgatcttagccaatttgtgggcgcgttgcttcaagttctcagccaatactttcttagcagactctgaagcgatcactgccttacccgtggggattagaaagttacgtccgtaaccgtcttttactgttacgatatcgtctttgtagcctaaattcactacatcttctttcaaaataacttgcatattctgtctcctcttaattaattatttcatcaaatcggttacgtaaggaagcaaagccaagtgacgagcacgctttacagcctgagccacacgacgttggaacttcaaggaagtaccagtgatacgacgcggaaggatcttaccttgctcgttcaagaatttcttcaagaattcaggatccttataatcgatatacttgataccgttctttttgaaacggcaatattttttcttcttaacgtctactgaaggcggagttaaatatctgatttctgattgagttgctgccataattaattattctcctttactgtttctttagatgatttcagatttcttctcttagctgcatattctgcggcatacttgtcttgacggaaagtcaagaagcggatcacacgctcgtcacgacggaagttcaactccaacgtagcgataacactaggatctgccttgaattcaaccaactggtagaagcctgttgtcttcttgtcgataggataagctaacttgcgcaagccccagttctcttcattcacgatctcagctccttgagctttcagaaggttcgtgaatttctctaccgcttccttcatctgagcgtcagacaaaacgggagtcaaaatgaaaacggtttcgtaattgttcataaaacgctgtttaatattgattaataaaaaattttgcggtgcaaaggtagtgattatttcgtaactgacaaacaaatacatattattaaaaagaaaaaactttctattaacatgttttagcaaaaaaaatccatacccactcattcgggattctttttgcccgtctaaaggtaaaaacattttcttgacataaaaagaaaagaaccgtatcaacaaaacaagaattcatttcttgattccattaatacggttctccaatcctaatttttaccaacacacaatatttacacaagttcttttttccatgcaatctcgactccttctttttgaatccattgctggaaatccgttagcatattcttatcgctgcgaataatacgagcggatatttgctttttactggcataggtaattaataaacctacagcttctcctattccccactctactggatgggtacgataacacccatttgttatgtgagtcgtccctatatttttacatgcagggaacaaattatttacccgctgtggtaataaagcacctaacggtatttgaaaacgaagagagttgaaatctatataattgtctcctccacaagaaggatgcaaatctatatgataataaccaataccaacactatcataaaatgcagcagcagttgtttctcctgatatcaacttcctattctcttcgcccacatgctcctctaaaattctaaattccgctttaatgcggcgtgactcccttatataaggatatttagccattccatctttcgtaccaagcaaatttttacggagccttaatcccttccaaccaacaccaccatctggtcgtggggcttcagtctgtaaccaatataacaatgaaagattcaaagcttttgcggcatccacatgcttctgaaattcattctcgggcacatctataatattccctaacatataatcattctgaggccaattaacaagagtcgtgctcccttggtaagtatctggaagaaaattatgctgatctataattctacgatacatccaaaagttaaaagcatccgttggtgttccatcaggaatacagacggcatgattaggttttaatgtagatggtgtcggataggtcatactcaacaatttacctggccatgcaggagttaaatttggtatatagttagcccaaaacgtataattatctggcttatcgatcgtccaatcttctcccggtatgtattccatcgcaaaacaaacagtaaaagcctgattattcaaaggatttgactgcttagcagcatgcagctcttttgtatcttcttgcgactccgaacctgttacatattcagtcttcgtcagtggtagtaaatcaccacactctgtcgcatccacaaaataaggagcggtcaaggtaacaagttctccattttgtctatctcgtacagtaacagctaacacttcatctccctgcacatcggaactttgagccttatgatttaacaaaatttgtaattttcccgcactaacataaggcattagcatttccatcaagacctccacagaaaccatcggttcatggcatattttagatacaccaccattacccggatttagatatggattattacgagccgcctctgttaaatgataatgataccgataaaaatcacgtattttatttctatacattcgataagatgcggtagctccaccagactcaatccatttatgttcgtctggcggtacaccttgctgagaaacctgtccaccaatccaatccgtttcttccgtaagaattacattcataccatttctacaagcggctaacgcagttgcacaaccgcccattcctcctccaacaaccacaatatcagctttcatttcctctactttcgctcctccttcaatcggcatggaagaggaaatcttattccctttttggcaagctgtcacaagaggaagcaaaagcgagcttcctcctgtcaataaactataagtcaaaaaatctcgtcgtttcatattttaataccctttattttgaactaatttaggattacgatccaattcttgttgaggaataggccataactcaaatttagcatcccaataacgatttgcgtcccttactttcaatttctctttataagactcataatcaggaatatcatttaaatcatgacgatccgatttcttaaaataaggaatatcggtctcagacaaacctttataacgaatttcctcgataggacgaccatacatcggtttctcattttctaaatccccaattccccatcttctcatatcgatcagatgcaatccttcaatagcgaattctaccttacgctctcttcttactaattgacgcattttctctatatttccgattctatcagccgatacattgggcatccctacacgatttcgtacttgattgattgcgtcataaacgctctgatccaactcccctagttcaatcttcgcttccgcataaccaagtaagatttccgcataccgcatgattggtacattttgacttgtatagctaatattttgagatgtttctttactatatttagctataatataaccacacccggcattggtaaaactagcccaagctgcagcgctatttatatcatcattatttctaacctcccattcaccagtcgtataattatattgttgtgtctcgtcatcataggcattgataataacggtattcaaagaaccattattacaagtagctgtatctccatgcatccataaagtagccttgaaacgagggtccctgttcttttgtgggtgatgtacatcatatagtggagattcatcaatacgtttcccatctatacattcataagtatctgccaacagcatactcggatgtcgagacgtttgtccttgcatacgagagacaaaaccaaatccagtccaattcctgtgaacattcgtaccatcaacattatagatcatctccaaaatcatctcgtttcggacatctgctttcgcctgtccttccacgacaaacaaatcctcgtagttcaatgccagcaaacgtttcccgatcacttttgaggctgcttcagcggctattttaaaatattcagtactttttcctccgaaatctaaactcccccctaataaagccatacgattgataagaccatacgcaaatgatttatcaacacgtcctctatccattgcgatccaatctagatattcggtagcttcattacattcgtttataataaaatccaatattttaacccttgatgttttttccacctcatactgatcggaagtgggaggttctgtataaaaaggcacatccccccataaagcgattaacagataataataatacgctcttaacacacggacctccgatacatactgtaaagacttcttactaagatcatccatattcggcctcactcctgttaaaaatgcgtttgctctcgctacgttcgtataaagttgggaccagaatttaagtatatcgctgttatccgcatttaaaccacctcccgcaccaatcgtcgtattctcatttctttccagagctagccctgtataaaaatcaaagattgtcgtatgggcgagttctcctacaacctgcatatataagttcgaatatacaccagttgccccttctctgattgcgttctcatttgtataaaatccctcgtttgtgtaagacggattcgtatcttctacatccaaaaaatcactgcatgatatattaataaaaacaagtaacacgcaaatcgtataaatgaatctgtatcttttcataacctttcctttaaaattttatatcgacaccaaatgtataaacctgagtaaccggataataagatgatacatcaccttcaggatcatatcctttatatccttttgctattgtgagtagattttggccgcttagataaaatcgcacattactaagccctgatttacctaatatattcttaggcaatgaataacctacactcacgttctttaaacgcatataagccccactctttacccaaaaagaagaaggaatattattcatgtttcctccgcctgaaccatcaatcaataatagaggatattctgcatttcgattctcttcagaccaagaatccaactgatgttcgtaaacagtacctcccatccaaaacggccttgctcctgctccgttaaagaatatatcccgtttacccactccttgtaaaaacacattaaaatcaaagttattccattccgcacctagattcagactaaaagaataacgtggttgtggatcaccgataatcgtacgatccgcatctgtgatctggccatcaggtaccccttcagggccactaatatccttatattttatatatccgggctttacattatctttattattcccataaactggatagctattaatctcctctttagactggaaatatccatcagccacatatccataccaagaacttatagggaatccctcttgtgtcgtattattatcattaatatacttatttccatacagatccgtcacctcattttttacatcggataacatagccctaatgttatatttcacttttcctatccgatcatgccacatcacgcttaaatcccaaccgttatttctcatattgcccgcattctcccatggagaagtcaaaccaaccgcataagtcacgggaaattgttgcaacatatcgctaatttcacggatgtaataatcaaacgtcacatccaaacgggtattaaaagcggtaatatccaatccaaaatcaaactgctgtgatttctcccaagagatttcaggattagacaacgcattggaataaattcctgtagtataatttttactatctccaaaccaatacgaggcatccaaggctaatacagacgcatatggataatagtccttgaggtcttggtttcctaaagaaccatacgaagcacggatcttcaaattatcaatcgcatcttttaatggatcgaagaaatgttcctctgatattcgccatccaatagacactgaaggaaaaaatccccagcgatttttagcagtgaaccttgatgagccatcgtaacgtccggtaagttcgattaaatatttgtccgcaaaagtataattaaagcgagcgaaatatgacatcatagtcaatttagaactattaccattaaccatagaggaagaggcatccccatgattcatttcctcgtagccatcatagtaataattattacgtgaaccaccaaacgacttatttttgaactcatcggtttgaaatcccaaaaagcccttaaaataatgcctttcattgaaagtattttcataagtcacctgagcgttaaactggttcttaatcaactgataccactcctcatacctagatttagtcgtaggataagtcatgataaaattaccaccctcataagtatcataggtattctgaaacttatcttgtttattctcataccgcctgctggcataactggccaagatctccatacctttgattggtgtcaaagcgagagttccttttacatctatatcattattatctacgaccttaaccccaccatcaatcgcttgcgctaacggattgataccattttggccatttccccaagttccatcattattaacagccccaaaaagaggtgtaaaacgcaacgtactatttataatattatttgttccactcgtcgggtctttttgaatgcttctacggatattcaggtttaaacccgccctaagccactctgttagcttaacgtccgtgtttgaacgaatagcagtacgtttgaacgaattatttggtattaaaccatcctcataattataggaagcattgacaaatgtctttaacacatcactaccaccactaacactaattgaatgattatgtgttaacgtgatttcatcaaatactaaatctttccaattcgtatcatacctatgaatattatctgccccagaagttttataggcattaattacctcttccgaatattgaggggcttgattattattaacgcacgcttgattgatagcctccatataagtgaccgcatctacgggattaggagtcgaggtaggcgtacgaaaacctacataaccattataagagaccgataatttattttctttagcccttttggttgtcaccaaaatgacaccattagaggcacgagatccatagatcgacgctgatgcagcatctttcaatacagagacagactctatcgcattcatatcgacagagttcatatccccctcaactccatctatcaataccaaaggctcactatttgaattgatcgatcccgttcctcggatttggatggaggccgtcgctcccggagctccggaactttgggtaacaaccatacccggtatcaagccttgtaaggcttgagatgaactggaaaggtttcgcttcgttaaatcctgactagaaatactttgcaccgctcccgtcagatttaccttcttttgtgttccatatccaacaacgaccacctcgtctaaagcttgcgtatcctcgccaagtttaacggagaaatcggtctttcctgagaccgataattcttgcgtattatagccgatatatgagacttgaagagtagcattaccgcttacctctaacgtgaatttcccatcaatatcagtgatagttccgtttgcagtccccttctccacaacatttgcaccaatcacagggataccttggttatcgacaatcacacccgatactctttttctgtctttcgtggtatcatccgctttctccggtacaataagtatgtaatttccatttgtcttatatgtgtaccccgtattctttaacaattgcgataaggccaacaagacttccatttctttttgatccatcaagacctttctcgacacatccaattgactgtcattataggctatcttataagtcgagactgactctagtttctcaaatgcttgttttaaagagataaaaccgtcatgaaatgtcactttttgcgcatcaataggcaaactccgaaccatagcaagactcaaacaaagaatagtgatacatatagatttattcctgttcatgcgatattagattttttagttaaacatttatatttccttctatagtacgtactcgttattaggacaaggaatacgaaggatacacctaacagaacaaagttaacaaatgtaaaacacagaacattgagtaatagaaatttcaaaggacacaaacaccaaactgtttatcgaaagctcgtatctattgttcagctcgacaaacaaacagtgagataaagtttttacttctaattggtaaacacactcgtttctatatatactttcacttttaaaagaagactaagaaatatacattttaatcaatatagactccatcctctttgatctgatactctaaaccaggtactatctccttgagcagcatcatgatgttcaccaatgactcattcttattgaaatggatcgtaagccggttggaatgataagcggaggtacgtaaatgcaccttcacattatagacacgttccaaggtttttaaaatatcctcgaaagaatcgttgttaaacaacaagcctccctctttccatgccgagtaatccgagcccaccacctgccgcacgtccacctttccccgggaagggatgtagacaagctgctcgttaggactcaatatacatggagccaccgagggatcatcaggaaggatcttcaaggaaccttcctccaaggttgtcgttatcttctcttggtccgagtaagcggataaattaaactcggtacccaacacttgtacccgcatcgctttcgtccgcacaatgaaaggttgctcaggacgttttcgcaccttgaaatatccctctcccaccagatagatctctcgcttatccccgataaagtcggatggataaagcagcaaggtaccggaattcaaccagacctcgctaccatcgggcaaggtgatccgctcccgcttgccggaaggtacgaaccgctccataaaagcgagctgcctgacatcccgtgcgtctctatatagataataagaaacacccaacgacaacaaagggatcagccagatagcggcgatacgcacccatgccgggatacgcagacagggacggggcctcacgtccaatgtattctccaaccgggcgaaagccatctcgcttcgtttatccgcctccggaaaaccgatctcattccagatctcccgtaaaacctcttccttttcccgttcgtctcccggctccgccaatcgttgatgtacccgatccaccatctccccggagaacgaatgatggaaaaagtattttaatatcttttttataggactcattcctgcttttctattttatcttgtttataggacctacttttctcactttaccctcaattcattaacatatcataacaagaaggaaagtcaatactacgttccgcaattcccttaacgctagattcaaatgtttttccacggtcttttttgagagttgtaaattctcggcgatctctgtgttcgacaatccctcattacggctcatccggtagatcatcctccgctgtggcggcatggtctctacaatcatatccaccaacaatcgcaaatccttagcgactaaatcctcataaggcgtacttcgctcctcgtcttcctccgaagcactctccaagctcacgagattcacccggcgggattcgatataattgaacgccgtatgcttcgccagcacatagaggtaggaaccgaacgtcctcacttccgtgaaacgactccgatgcgtccaaagctttaggaaaatctcttgggtcaagtcctcggcatcgttctcggacttcacgagtcccagcacgaaataatagactttcagatggtaacgcatgaacaattcccggaaagcggtatgatttccagcggcaaattgttctaaaatggatttttcatctgtcatctcgattaactcctttcacgatacggtgggagcaaataaagtaataataaccggccgtaagaacgcttttcttgttaataaatacaaaattgaaagaaatcccccgtatatcaagccctcccttcccgaagatttaaggcttctaaaggcatcctttagccgttttctccgtacctattcatattctaccatccgttgtatgatcatccaccaactgttagaagatcatgcaacggatggtggatgatcatacaacggatggtagaatatgaaagtctacgctcgaaatcctttaaatgtaggtttctttcgcctaatgtgtgatgaagaatcgcttaccgcttccttatgttcttttttttgtctaagtttgttccttcaatgacattcaatatgtattggttacatcattctatcaatttactcaagatcgtgccctttttgggtggttggttatccgaccggttgctgggagacccggaaggttggccccatcctatcgtatggtttggcaaagcgatcagcgccggagagaaagagttgaataaaggctccgagcgggtcctaaaaggcggcatactggcagtcgtgcttatccttggcgtgtatttaatctgcgagtggatattgtcgtgggcttggattatacatccgcagttcagtgggttgctgacggctgtcggcgtattttattgcctatccggaaagacgcttatcaaggaagtgaaggcggtgttcgaggccgtggaccgtagcacggaagaaggacggcggcaagtggcacggatcgtggggagggatacctcgaacctgtcgccgcaagagatacgggcggcagcgttggagaccttgtccgagaacttaagcgacggcgtgatcgccccgatgttttggtttgccctgctggggttgccggggatgatggcttacaagatggtgaatacactggactcgatgatcggttataagaatgagcgttaccttgagttcggacggatagcggcgcaaatcgacgatatcgccaattacatcccggcccgcctcacggcctatttgatgttgctggtctccaataattggggaaaaagggatttcgtacggcgtttcggccctgaacacgcaagccctaattccggttatccagaagcggccttggcggcggtcttggactgccagttcggggggacgcacgattatttcggcaaaccggtggagaagccttatatcggaacgaacgcgaggcctttcacgaccgaggatatgcgtatcgccattcaagtgaatagtaatacggaactggtgatgggtgtgatcgtcacccttattttactaataatataatattaataatatggaaattagattaaacaaactgataagcgaagccggtgtttgctcacgccgggaagcggacaatttcatcgagatggaacgggtaaccgtaaacggcaagcaaccgcacgtaggccagaaggtcacggcggaagatgtcgtattggtggacggtgaacgcttgaacgtagagaaatatatccgcctgcaagaggaggagaaaaaggaggtgcagcaagaaaaagaattactcggcacgctccggaaagcgaaacccgagaacaagggaggccgtgaaggcgctaaaatggagaagttcggaaagttcaataaatacgctgccgcccgtaaggcgcagaaagagggaggctggaaatccaagaccgccaagcttaccgacgaggagaagttattgcgggatgccttacgccccaagttcggaaaggcactgagcaaatcggcggtggcgcagcggatcgccgccaacccgaaatcggccgcccttcggaagacgagcaagaacaatccgatcaacaaggctaaacgtgccgcccaccggaaaaacaggaatcacgaaggcgatgagtaagaaagtgatcttagtgactggaggacagcggtccggcaagagcggatacgcacagaggctcgccttatcgctgtcgcccaacccggtttacctagctacctcccgcatctgggacgaggagttccggaagcgggtggaacgccaccagcgagaccgtggacccgagtggaccaatatagaggaggagaaatacttgagccgccacgatcttaccgatcgtgtcgtggtgatcgattgcgtaaccctttgggggacaaatttcttcttcgacaatcaaagcgacgtggaattatccctctccctcctcaaagcggagttcgataaactctcccggcaagatgcctacttgatcttcgtgacgaacgagctgggtatgggaggcgtgccgatagacgaggtgcaacgtaaatttaccgatatgcaaggctggctcaaccaatatatcgcctctaaagcggacgaggttgtcttgatggtcagcggaatccccgtcaagatcaaggaataagaacaacgacttatataaaatactactatcatgatacaatttcacatcgaggccccggacaaagggctggaggccgctttacaagacaagatcgataatctgacaaagccgaaaggctcattgggaacgctcgaggcgctcgccctgcaagtgggattgatccagcaaaccttatcgcctgtcttgcgtcatcccgtgaacgtaatctatgcatcggatcacggcatcgccgacgagggtgtaagcaaatctcccaaggaggtaactcgccaagtgatccataatttcttgaacggaggagcgggagtttgctaccttgcccgccagcatgggtttgagttgaagatcgtggatggcggcgtggatttcgatttccccgttatcccccaacttatcgaccgcaaggtgcgcaagggaggaacccgtaactttcttcacgaggcggccatgaccgtggaggaaatggagaaagcccttcaatacggagccgatatcgtgacggattgttacaacgaaggctgtaacgtgatcagtttcggagagatgggtatcgggaatacggcggcttccagcatgtggatgacttgcctcacgcaaatcccattgatcgactgtgtgggggccggtagcggactggacagcgaaggcgtacggcataaatacaacgtactgaaacgctcgttggagaattacaaaggggatggaagcgccttggatgtaatgcgctacttcggagggtatgagatggttatggctgtaggaggcatgttgcgtgccgccgaactgaagatgattatcctcgtggatggttttatcatgacgaattgcgtattggtggcttcccgcttatatccggaaatgcaatcgtattgcgtattcgggcattgcggcgacgaggccggacataaacggatactggatttcttgggggcaaaagcattgctcgatctagggctacggctgggagaaggttccggctcggtatgcgcttacccgatactcgactccgccgttcgcatgatcaacgagatgtatagtttcaagcaagcggcaatcaccaaatatttctgatatgttgcggatactcgctgcgtttatattctttactcggttaccgttctggcggttggcggaggttccggcggcctgtttcaagaatatcgtgagccattgggcgttggtcggttggctgacggctggtttgtcggtattggtattgtacgctacctccttgattcttccgccatccgtggcgatcttatgcgccatgattacccgattgctgataaccggctgcctgcatgaggacgggctggcggatttcttcgacggtttcggcggcggcacgagccgggaacgcatattggcgatcatgaaagactcgcatataggtagctatggggtaatcggactgattttctacttcggactattctacctactagtaagcagtctcccgatcgagctagcgggatgtgccatactggctggagatcctttttgcaaaggcgtctccagcatgatcatcaatcgcctgccttacgcgaggaaagaggaggaagccaagaacaagaccgtatatagccgaatgacctctcgagaatatgtatttagcatcatttgtgctttcttaccattattatggcttccccaacctgtttacttactagcgggtatattcccggttatcacttggtatttccttacctctttcatgaagagaaagatacaaggatatacgggagactgctgtggagcgacttttcttcttagtgagttaagcttctatatgggtttcgtgatcatctatcaaactatataattatggagatttatttaatcagacatacctctgtcgatgttcccgccggctacgcctacgggcaaaccgatgttccattgaaaccgaccttcgaggaagaggcggaagaggtaaaaaaaggcttgagcgatcatacgttcgataaggtttggacaagtccccttacccgctgcgtgcgcttagctaattattgcggctttccggaggcggagagagaagaccgtatcaaggaggtgaatttcggggaatgggaaatgaaatcgtggaatgagctatcctccgatccccgctcagaggcttggttcaaggattgggttaataacccgactccaaacggtgaatccctacaagatcaatacgaccgggttagcgacttcttgaatgagcttcgcaaaagcgagctgcaaaaggtatgcctattcgcgcatggcggggtattgacttgtgcccgggtctacgctggcgaatatcctttgcaagatgcttttaagaacgtaccctcttacggggctatcgtaaaattagtgctggattaaccaaaatccggcacatttcgaaaggataagatgcggcacgccacatctctacaacggctggtgccatataacaaaaaaaggagccaatctttcgactgactcctttcacctaagacggcggctacctactcttccactgttacgcagtaccatcggcgtgacgaggcttaacttctctgttcggaatgggaagaggtggatccctcgtgctatagccaccttaatatcattatcaagattttgaccggacatcaatccgaagagactcgcttcgccttatcgtcttaaaatatatcaaccttcactgtgaggaaagtcccgggctattagtaccactcggctcggacgtcgccgcccttacacctgtggcctatcaaggtcatcgtctataaccacccttgagggagatctaatcttgaggccggcttcgtacttagatgctttcagcacttatccgatccgtacttagatacccggcggtgcccctggcgggacaaccggtaaaccagtggtacgtccgacacggtcctctcgtactagtgtcagagcctcgcaaatctcctgcgcccacgatagatagagaccgaactgtctcacgacgttctgaacccagctcgcgtgccactttaatgggcgaacagcccaacccttgggaccttctccagccccaggatgtgacgagccgacatcgaggtgccaaaccattccgtcgatatgagctcttgggaatgatcagcctgttatccccggagtaccttttatcctttgagcgatggcccttccatgcggaaccaccggatcactatgctctagtttcctacctgatcgacttgtatgtctcccagtcaagcgcccttatgccattacactctgcgaccggttaccaatcggtctgagggcacctttagaagcctccgttacgcttttggaggcgaccaccccagtcaaactacccaccatacagtgtcctcctaactaggagttagaactcaaacaaccgaagggccgtatttcaacgtcggctccacaaatactggcgtacctgcttcaatgcctccggcctatcctacacatcgtctgcccaaactcaatgtaaagctatagtaaaggttcacggggtcttttcgtcccatcgcgggtaatcggcatcttcaccgatactacaatttcaccgagctcacggttgagacagtgtccagatcattacaccattcgtgcaggtcggaacttacccgacaaggaatttcgctaccttaggaccgttatagttacggccgccgtttaccggggcttcaattcaacgcttctcctcgcggatgacatctcctcttaaccttccggcaccgggcaggtgtcaggctgtatacatcatgtttccatttagcacagccatgtgtttttgttaaacagttgcctggacctattctctgcgcctcgccttacgacgaggaccctttatcccgaagttacagggtcaatttgcctagttccttaaccgtgaatcactcgagcgcctcagtattctcaacccgaccacgtgtgtccgtttacggtacgggtgccgcatggataagtttagcggattttctcgggagcatggttacgtccatattacgtcgcgcaagcgctccgtatactctcaggttcgactctccccgcggatttgcctacgggaatcaatatctacacccttcaaccggctattccgtcagccggcaggactgtcacttctccgtctccacgtcactccatgaggcagtatgggaatattaacccattcttccatcggcggcgccgttcggctttgccttaggtcccgactcaccctgatccgattagcgttgatcaggaaaccttggtctttcggcgggggggtttctcgccccccttatcgttactcatacctacatttgcttttccatgcgctccaacaagggtcatccctcatcttcgacgcggcatggaatgctcccctaccatgtcttgcgacatccacggcttcggcagatcgtttatgcccgattattatccacgccagatcgctcgactagtgagctgttacgcactctttaaatgaatggctgcttccaagccaacatcctagctgtctctgcgatccgacctcgttagttcaacttaacgatcatttgggggccttagccggtggtctggattcttctcctctcggacacggaccttagcacccgcgccctcactccctgtaaatatatatcgcgcattcggagtttatctggacttgataggcggtgaagccctcgcatccaatcagtcgctctacctcacgatatactataaagaggctgcacctaaatgcatttcggggagtacgagctatctccgagtttgattagcctttcacccctaccctcagctcattggaaagcttttcaacgcttacccatccggtcctccagttggtgttacccaaccttcaacctggccaagggtagatcactcggtttcgcgtctaccccccccgacttggcgccctgttcagactcgctttcgcttcggctccgttcctcaagaacttaaccttgccggggaaggtaactcgtaggttcattatgcaaaaggcacgccgtcacgtcattacgacgctccgaccgcttgtaggcagacgggttcagggtctatttcactcccctgctcggggttcttttcacctttccctcacggtactggttcgctatcggtctctcgggagtatttagccttacgggatgggccccgctgtttcacgcaagatttctcgtgccccgcgctactcaggatgccactaggcttcaatcgtcagtcgtgtacggggttttcaccctctatgaccgccttttccaaggcgttccacttgactctatcttgccacgtcgtggtcctacaacccccgtgtcgcctagacgacatgggtttgggctcttccgtgttcgctcgccactacttacggaatcattgtttattttctcctcctatgggtacttagatgtttcagttccccacgttcgcctcccttacgggatggcaggccttcagcctgccgggttaccccattcggatatcccgggatcaagggctatttgcgcctcccccgggcttttcgcagcttatcacgtccttcgtcgcctccgagagccaaggcatccaccgtctgcccttgcttactttctcccacctcgcacttgacgcacgggttgatatatcttaagctcgctctacttgtttcttctttttgatgtccaacatgtcaaagatcctctttccctcgcgggatgtgtggagaataacggattcgaaccgttgaccctctgcgtgcaaagcagatgctctagccagctgagctaatccccctcattcggagtagtcccaggcagagttgaactgccgacctctacattatcagtgtagcgctctaaccaactgagctataggactgtcaactttgccaagacttacgtcccagcgtcatctttttctctccgaccggcctcccggtctgtaagatctatatataaacataatctcaacagcagcacaagggatcaatacctcgtatgacctcggtacggaatcctaaagctccagaaaggaggtgttccagccgcaccttccggtacggctaccttgttacgacttagccccagtcaccagttttaccctaggccgatcctcgcggttacggacttcaggtacccccggctcccatggcttgacgggcggtgtgtacaaggcccgggaacgtattcaccgcgccatggctgatgcgcgattactagcgaatccagcttcacggagtcgggttgcagactccgatccgaactgagacgtggtttggggattcgctccctgtcgccaggtggcttccctttgtccacgccattgtaacacgtgtgtcgccccggatgtaagggccgtgctgatttgacgtcatccccgccttcctcgcagcttacgctggcagtcccaccagagtcctcagctttacctgttagtaactagtggcaagggttgcgctcgttatggcacttaagccgacacctcacggcacgagctgacgacaaccatgcagcacctcgcaaatcgctatcgctagagactctgtttccagagctgtcgaaatgcgttcaaacccgggtaaggttcctcgcgtatcatcgaattaaaccacatgttcctccgcttgtgcgggcccccgtcaattcctttgagtttcaccgttgccggcgtactccccaggtggatcacttaacgctttcgctgtgccgcttacagtgtatcgcaaacagctagtgatcatcgtttactgcgtggactaccagggtatctaatcctgtttgatccccacgctttcgtgcatcagcgtcagtaatggcttggcaggctgccttcgcaatcggggttctgcgtgatatctatgcatttcaccgctacaccacgcattccgcctgcctcaaacatactcaagccccccagtttcaacggcaattctatggttgagccacagactttcaccgctgacttaaaaggccgcctacgcaccctttaaacccaataaatccggataacgctcggatcctccgtattaccgcggctgctggcacggagttagccgatccttattcataaggtacatacaaaacgggacacgtcccgcactttattcccttataaaagaggtttacgatccatagaaccttcatccctcacgcgacttggctggttcaggcttacgcccattgaccaatattcctcactgctgcctcccgtaggagtttggtccgtgtctcagtaccaatgtgggggaccttcctctcagaacccctatccatcgtcggtttggtgggccgttaccccgccaactgcctaatggaacgcatgcctatctatcagcgatgaatctttagcaaatatccccatgcggggcccctgcttcatgcggtattagtccgactttcgccgggttatccccctctgataggcaagttgcatacgcgttactcacccgtgcgccggtcgccacccggtattgctacctgtgctgcccctcgacttgcatgtgttaagcctgtcgctagcgttcatcctgagccaggatcaaactcttcgttgtttaaattgtttcttaatatcctcgctccggaatccgtttatcgtagtccaaagtcatacttctattgacggtattaatccggagaatctcttctccaatacttgtactacttgttgaattatgtaaatctctcaaagaactcttctgtcgctttcgttttgcgaacgtggctgcaaagataaggacttttattttaaacttccaaattattccggaactttttttctaaaagtttgtttcatcattttgtaccggcgttctctctcgaatgcgggtgcaaaagtagtgttataaaacataacctccaaactttttcggaacttttttgcaatatttttttcatgagggggactgcgtacattaaataatacgtgacgctcttttttaacttacgagtcaccacgtgtaccgaaaacagggctctcacgagtgcttttacacgtataaaaacgataaacagggtcctggcgacgagaggaaatcatacgggaaaaacggctttctgctcatggaatcacgagaaaatcgctctgtacacgtgcttttgggccacgtaaatgtgagtttaggccgattatatcgcccaaaagactaaaaaagggttaagagaacagtattacataaacaactgtctatctatactttaagacatcaagaaaatcttcaaaaaaatcacagggcgcattagggcgcatctttacgtgttcgcaaaaacattttacaaaaaaaatatattactccatctatatataagtaagacgctaatttttttataatataaaagttttacaaacctcgcaaagatgcgccctttgcgccctgaaccatcccctaccaacttatcagggatacaaaaaaaagcctatgggacacggccgtaaagtcattgagataacacctctatcccattgactttaccaccgtttcccattgagatactatcgtaaacccgacacttcaagaagggataatcattccccagataggcgtcttgaccatgaacacgaatagttcgctcgcaactgaactgaaccgcaccatcgtcccgttaatcgctacccgtcccatgataaggacaaatccgttcttctccttgctgccgttcacatagatttgacttctcccaatatccacaatttgcccctaccttcttcatattcaattttaattgcgccaatctgggctttttataaggttattacggagattttccgtaaatttgtagaaataagacagccaataatatttataaaaatatgcgagaaaaactctcctatcctgttaggatcatcatatccttactatccatttttctctggagctttccggcagaagggcaggatagtgaaagcttaaaaaagcaattggatcaaaagctaaactctttcgcaaggcaatatgtgtcttcacgcaccattaagattgactccatcctcatgcagaagaagaaagtcacgcttttcgccaatgaagctttggaggacatcccttttcgggaatacaacgtttctgagctttacgcaagtatagctcccctatttcccaatgcctccaagatcgtcatcttgacccgaggtacagacattgagagcctgattcccgaatacgacagaaaaggacgtcccaacaaaaagaggctatactccattaaagagagcaaatacccgctaacccgtagcctatccagccctcatgagataaaaaacggattacaaaaccgtcatatcgccctttggcaaagccatggtttatattacgcccagaccgcccatcgctgggaatggcaacgggcccgcatgttcggcaccgtagaggacttatttacgcagagttttgttcttccttatctgaccccgatgcttgaaaacgcaggagcgactattctaattccccgggaaagagacacccaaatatacgaaatcattatagacaatgatcgctctactccgggatccgagtataaggaattggatggggagaaagcttggtcggatggggagaaagctggatttgggcatattcaagctacttatacgaatggggagaacccttttacgcaaggtacctatcggcagacggtcacacagaggaaaggaaaagaaagtctcatcgagtggattcccgaaattccggaatcggggaattacgcggtctatgcctcctatcaatcttttccgaacagcacagagcaggcactgtataccatccatcatgccggaggggaaaccacaatcgccgtcaatcaaacaatggggggtgggacttggatctatctgggaaacttcaaattcacggcacatgaacaagcccatgagagaatcgtattaacgaatcaaagcaataaatcgggaaagattatcacggcagacgcaatcaagatcggtggcggcatggggaacatcgcacgtagcccgctagaaagtccctatccgatagaagcagagacaagtgggtatccacggtttaccgaggcggcccgatattggctacaatgggcgggaataccggatagtatctattcgaaaagcgctttccgcaatgattatcaagacgacatttacgcacgtccccaatgggttaattatttaaaagaacagacccatatccctatcgacatggccttcgcattccattccgacgcaggaaccaccccggatgactcaattatagggacactcggcatctatatgtctaaaagcaacgacggaatctacaccaaccggaaaagccgggagatcgccagagacctaaccgacatgatccaaacacagatcctgtccgatgtccgcaaggtttacaatcctcaatggagccgccggggcatgtggaatcaatcttatatagaggcacgtattcccgatgtcccaacgatgctattagaattactatcccatcaaaacttcgccgatatgcgttacgggttagacccacgcttccgtttccttatttgtagggcgatctataaagggatgctccgttatatctgtttccagaataaacaggagcctatcgtacaaccgctcccacccgatcgtctgtatacggagctcgtagaaacgaataaagtgagaatcggctggaaagccgtacaggatactcttgaggagagtgcctcaccaaccgcctatatcctttatagtcgaaaagacagcggtggattcgataacgggacgctcgtaaaaggagaagaaatcattcttccaattgagacgggtattatccatagttataaggtagctgccgtaaataagggaggcatcagtttcccttccgagatcgtaagtgtttaccggtctcctaaaggtgaaaaggataagacggtattgatcgtcaatggattcgacaggatcagcggtccagccagtttcgagagtacggcggatagtttagccggctttctttatgccgtcgaccggggagtgccttatctgaatgatatcgcatttatcggggatcaattcgaattccgccgttccgccacatggaacagcaatgataataacgggcatggggatagttacaacaattacgcaggccaagtcatagcgggcaataccttcgattatcctttcatacatgggcaggccatggccgggaccggttattcctttgtctcatgtagccataaatctttggccgagggagtcgtaaagccggatacgtatccgattattgacttgattttaggaaaacagcgccaaccggttatcactcccgttttacaggatacgcttcgcagctaccttgcccaaggcggcaacttgcttgtaagcgggacgaatcttttctccgacagctggggcaacgcacaagaccgtacgttcgtcgaggaggtactaaaagggaagttggctagccgtaatgccagcaaggagggaatcgtaaacagttgcgcatccccttacggatatataaacggcagatacacgttccggacacgtccgaaccctatttgctactcgatcgagtcggtagacggtgtacttccggcggataagctcgcccataccatcttgagatatccggagaacaatatcggggcgggaatcgtttatgaagggaaatatcggacttgtttgctcggtttcccgtttgaggcgcttcaaacaccgtcggaacgaaatcgactcatggagtccatcttacgctttttctccattcaacaacaaaataaaatacagtatatacaatgaaacgaatcaattgctttatcccttatggaaaaatagaggctacacgacaaacggtagcgcaattggccgagtcgtccttagtgagtcagatctatctaatcacggacgatccccacgccaaggctatttatccctgcaacttaatccgcacggagaatatatggagcacgaagaccctccgggaaatagccggctatgccagtgcccattatacgttaatttatacgaagactgaagagcttcaattaggcatgtatgccctagagcgttttgtcgccatcgccgacgatacgagatccggtatggtttactccgattattacgagaagaaggagggcaaactcaacccccatccggtgatcgattaccagaaaggaagtcttagggatgatttcaatttcggctccctcctactctatcgttcttccacgctacaaaacgccatagcctccatggatacggaatatacattcgccggactctacgacttgcgcctgaaagtctcccaaaacgctccgctgacgcatatcaacgaatatctatatacagaagtagagaatgatttacggaaatccggagagaagatgttcgactatgtagatcccaagaaccgctccgtacagatcgagatggaagccgcctgtacagatcatttaaagatgataggcggctacttgccccctcatttcaagccagtccgttttgacgagcagacatttcaaacggaagcctccgttattatccctgtacgtaaccgtgtacggacgatcgaggacgctatccgttccgtactgcgacaagaggcgtccttccctttcaacctaatcattatcgataatcattccacggatggcacctccgagcgaatccaagcgatcgccgccacggaccttcgtattatccatatccagccggagcgtgacgatctcggcatcggggggtgctggaatataggaatacaccattcggcttgcggcaagttcgccatccaattggatagtgatgatgtatacagtgacgagcataccctgcgtaagatcgtggaagccttctacgagcagcgatgcgccatggtggtcggaacctaccgaatgaccgatttcgatatgcgaaccatcccgcccggaattatcgaccataaagaatggactcccgagaacggccgcaataacgccctccgcatcaacgggcttggagcgccccgagccttttatacacccttgctacggaaactaaacctcccgaacaccagttacggagaagattacgccctcggcctacgtatcagccgcgagtacccgatcgggcggatctacgacgtgctgtacctttgccgccgttgggaagataactccgacgcctcattggatgtcgtgaaaatgaacaaccataatatatataaggataaaatcaggacttgggaactcgaggcccgcttaaacatggaaagacaatgaaaccaaacaactgggtcagctcatcgcaagcgaccgaattactgtccaagcaactcgtgacatggccattggccgagaagaactataaggcgctggaggccgtgcaagtaaaatccttcgatatgggagggttctcgatacgtgcgcaattcaatcccgcccgtattgtttccaccggggccaaggtagatgcccgatccctaaaagaacgcaaatgcttcctatgtcccgagaacctgccggtggaacaggagcggctgcctttcggctttcgccatctggtattgtgcaacccctacccgatcttcccccagcatttcacgatccctacccggaaacatactccgcaactgatattgccgcaatggaatgacttcttggaactgacaaggagactcgctcccttcaccgtcttctacaatggaccccgtagcggagcctcggcaccggatcatgcccacttccaagcggtgacacgaggcatcatgccgctggatgaagaggtaacccaatttatacggcacccgtatgcgagcgtatacgacacccgtatattcccgctcaccggaaacctccgccccggcctcgtcatccaagccgccaccgccgaggccgccacccggctcttcaaggagatctacgctgccctgccgcttccccccggcgagcccgagccgatgatgaatatcttcggctcctattacgataataattgggtaatcacggttatccctcgtaaacgccaccgcccatggcaatacgaggctgaggggaacgaccatctcctgtccagcccgggagctgccgatatcggaggtcttttcatcacccctttagaaaaggatttcaagaagatcaacccggagcttctgcgagatgtttaccaacaagtatgcctcagcgaccgggacgtagaggaaattttcgtacatttgtcatctaattagttttcaatagatatgaaacaattctttaaaatgatgtttgcctcaacgctaggcgttatgttggcaatgggaataatcctgacggtattgatatccatgactataggatatatcgccaccgtaggtagcacacctgattacacccccaaaagcaatacggtattcaagatcaagctagacgggacgctagcggataacccggcggagaatccattctccgccttgatgggcgacaaggaaaacatgctgtcactgaaggacctgctcgagacgatccggatagcgaaacagaatgacaagattgcggggatttatatcgaatcggggcttctctcctcgggtagcgccagcttggaggcaatccgccgatcgctgatagacttcaaggaaagcggcaagttcgtggtagcttacgccgataatttcacgcaagggaattacttcctttgttccgtagccgataaggtattcttgaatccgcaaggcatccttgagttgacaggactcgcctcgcaaaccctattctacaaaggactgatggataaggtaggtatcgagatgcagatttttaaggtaggtacctacaaaggtgccgtggagccctttatgctggataagctgagcgaggcgaaccgggagcaaatccaatcgtatatctccaccatctgggataatataaccgaaggcatcgccgaatcacgcggcatcagcgtgaacgatatcaaccattacgccaatgaggggcttttcttcgcggaccctgtgaaaacggtagaatgtggctttatagacgaattgaagtataagccggaggtagaagcatacgtcaaagagctagccggacaaaatggagagaaactgagatcggccaacttagctcaaatgaaaaccctcaaggcctcatccaccaaaaacgctccggagatagccgtactttacgccgaaggcgagattaaggcgcaaacacccggtagcctatacgatatcgagcaaagcatcacggagaaaatggccgatgaacttatcaagctaaaaaacaatgacgacgtgaaagccgtggtattccgtgtgaattctccgggaggtagcgcttatatatccgaacaaatatggcgtcaggtcgtcgagttgaaaaaggtgaaacctgtggtcgtttccatgggcaacgtagccgcctcgggaggttactatatctcatgcgccgccaataagatcatcgccgagccaaatacgttgaccggctccatcggtatcttcggcatgttcccgaacgcctccggattattcgggaaactagcgttgaccacggacatcgtaaagacaaacacattctcggacttaggagacctctcccgtcccatgaccgagagtgagaaagcactgatacaaggatacgtggaaagaggctaccaaacgttcctttcccgttgcgccgaaggtagaggtatgactaccgaagcggtcaacgctatcggacaaggacgggtctggacgggtgagcaagcgaaagaaagaggtttggtcgatgagctgggcggtattgaattagctataagcacagcggcggggttggctgatctggatcagtatagcgtaactaccgtcagcggttccaagaatttcttggacgagttcttggaaagccagctcggagaggtgaaactctctatcgtcaaaaatgtattgggtaatgagttcgagtacttcaagacgttgaataatatcaagacgaattgcggaatccaagctcgtatgccttacgatatgaaaccgttataataactggaccatgctgacagatcatacgattaagttcaataaactcctcactccattctctttcctttatggaatcggggtgagattcaggaatcagctgttcgactggaaaatccttcggacagagcggtatgatctgcctattatttgcgtggggaacctgactgtcggggggaccggaaaaacccctcatacggaatacatcatccgtttgataaaagaccgataccgggtagctgtactcagccgtggctataaacggaaaacctccggtttcttgctggccgatcagcgaagtaccagcaaggatatcggtgacgagccgtaccaaatgaaacgtaagtttccggatattctcgttgccgtagacgctgatcgccgcaggggtatccgcaatctattggctctgccagagaataagcgcccggaagtgatcgtgctggacgatgcctttcaacatcgatacgtcgcccccacgctgaacatccttttaaccgattgccaccgtctttatacgcaagataagctcttgcccgcaggccgtttaagggaacctgtggatggcgctcgacgtgcggacgtgatcattgtcacgaaatgtgagtcatgtatacaacctatagacttccggatcatagaggaggatatacatctctcagcttatcaagagctctatttcagccgtattctttacggggagctggaacccgtcttttccggtaaagcccccagacgcacattaaaagggctggcctctactacagaggttttattggtatccggtatcgcatccccggcacctctcgaaaaagagatccataaatatacggagcatgtcacctctttggtctttccggatcatcacgccttcgatcggcatgacatccagaaaatacaaacggccttcaagcggttgacttctacaagtaaattgataatcatcacggagaaagatgccgcccgactccgtgaccttccttcgcttcccatggaatggttttctcatttatattgtttgcctattacggtgggtttctgtatggatcgggaaaaacaatttcaagaattaatagttaaacatattgatacaagaataaagaatcatcctatattacgttaacaatcttatgagcaatagaacagaaatatcgactttgggagagttcgggttaatccgccatctcaccgataaaatagaacttaaaaatccgagtacgttgaaaggtgttggtgacgacgcagccgtactggattacacagacaagcaagtattggttacgacagaccttttgctggaaggtattcatttcgatttgatgtatgtgccgttgaaacatctcggctataaatccgcagtcgtaaacttctcagatatttacgccatgaacggccgcccgaaacagattacggtatcattgggtatttccaaacgtttctgtgtagaagatctcgaagaattctacgagggcattaaactcgcttgtgatatctacgatgtagatctcgttggtggcgacacttccgcctcacgcacagggttagcgatcagcatcacttgcctaggcgagggagaaaaaggcaaagttgtctatcgaaacggagccaaggagaccgatcttatttgcgtgtccggcgatttaggggccgcctacatgggtctccaattactggaacgggagaaaagcatatttaatggggagaaagatttcacgcccgatttctctggtaaagaatatttgttggaacgccaattaaaaccggaagcccgcaaagacattgtcgaagttcttgatcaagctggaatcgttccgacctccatgatggatatctccgacggcctctcttcggagttgcttcatatatctaaagaaagtaatgtaggctgccgagtttacgaagatcgtattcctatcgattaccaaaccgcagccatggcagagcagtttaacatgaatctgataactgcggcattgaatggaggtgaggattatgaactcttattcactgttcctttagcagatcatgataaggtgtcggaaatgaaaggtattaaggtgatcggtcatataacaaagccagagttaggcaattatcttgtcggtcgtgacggaggtgaagtcgagcttaaggcgcaaggttggaactcactaaactaaaaagaaatatccgctctgaattcacgaatgcaaagcggtccgtctcatttttattgggggacggaccgttttcctattatttcatttcaatggatcctaaataattatagaagagttcaaaatcacttatcttcaagaaaggtaagtgataaacatccatctttataatttgagcctctatagccattttcccatacaaatcagccaaagacatactctttatatcaccgttatgatagaccttattctttttctcgggaagctgtaccttcttatccaagaaacggatataagtataagaggtagccagcggcttattataggtaggcacttttccgactttcctcatatcataaaaccctttcgcacgagccgtctcacaagagacattcatgaactctggtatattcacaaatcgaaagacacaatcatcccatttacaaaagccaatcttagccaacgcatccggctggtctgtcttaatttgtgggcaccacaacccttttaatggaaagatctgcttatccatatcatattgtaacatctccgactgactctcaatacgaaacaccttactaaaatcaacgtcccctaacgccttttccaatttagcggcatattctttcttaagatccgccatagtaaatggatcggcttgatttttctctaccagattcttgtcacaatgagccatataccttactatcacatcgtcatcaactgtcacattatttaatttaagcgcataaacaaataagagatcggacgttaaatcgaccataccttcaacttcgcttttaaaatattccgaaacaatattcccttgactaagcgcatcattaatatttatacaaagacgccgtccatccagttctaccacgacaagaggatgcgtttctacctcagaataaacgcccataccctcaaagagtttcttatcgtaatctggaatatcaacgatcaccgcctcttgactagccagattctctttcggcatcgtagaaatcttcccatcctttgtaaacgtcctaacaaacaaatatccggaaaccttagggacaccaaacataatcttatccccttttttatacactttcccatcacaggcagacaccgcatcacgagttcctatcccagcagcagcaaatgccaaacatacccaacttaaaacaatactccaaattactttcttcatatctatagcttattaatcattctctacccgcttccaaaaataagtaaaaatccatatttatctacacgctccccctatttaccctgcttatagcagctaattccacctctaccctcaaatattttcaaaaaatccaccgccacctattgcatatatcaaaaaagtccgtatctttgcacccgtaatcgaaacaacgatatacaaaacgacatgatggtgccatagctcagttggtagagcaaaggactgaaaatccttgtgtccccggttcgattcctggtggcaccactttttaagaaggcaaaacgatgtaaatccctaaatttcaaagaagtttagggatttttcattttcaagaataggtaaaataagtgggactaaagcaaactatacatccttattcgggagatagttttagaaagcctaaaatgttacacagcacaagtgctacttcgtttttttacagcacattgatctattttacataaccgggttctcggttcgatttcctaactttgtatcattaaaaattgagccgtatggaaagagaaatattcagcgtgttgttcttcatcaagcgtagtaaaccgttaaaaacgggaaagtacctttgcgtgtgaaattctatcagatttaccaagacttggaattggaggaaaagattgtctccgcacgtgccatagtaaaccgctatcaggaaaaggacgaaactttcaaaacattatacaatgtgttcaaggagtataacgacaacttggaaactccaatgaaacagatccccaatatccaacttaaattgacccccgatttatttttcctaaaatacaaaaaaatatcacataatcagtttattagttttcgatttgtgctgggtttataatttttatttactgccaatataatcattcatttcttcccgcaaattttgcgtatggactctccgtgcagctcaattcttgcggcttggtgagttattctgtccatgactacgccggctattgtcttcttgccgatgacatcatacctgtttttgaccggcaattgtgatgtaatcagtgttgatttcttaccatatcggtctttgatgatgtccatcagatgcattctgcttccgttgtccaacggctgcaagccgaaatcatcctgtataagcatatccgtcctttctatctttttcagctcctacaggatgctaccttttaccttggtggccttcaactgccctaaaagtctggaagtattggcatacagcactttcaatcctttctggcagactctgtatcccaaggctgtggtaatgtagctctttcctgtaccggagcttcccatgacaaacaagtcgcacgcctccttgacaaatcttgttcatgctgattgatttattgggaatactatctgttttgtctatttaatagattaatgtagaattatgaactgattctgtaactcttttaatgttttttggggtggggcaatttaaattggattttgggggactctttagataggataatggggggacagtttataccagattttccacctgtcaatacacagaagaattttcattgtttattaccgaaaaatagaagcagtctctacaaaaaaagactgcttctgcttcatttctaaaacaaatcaaaaaacaaatatgctcaactattaatcttaattttcttttaagaaacggatgataacacaggtttgtctgatacggaaaacaagtgctcactaagcgccttcaaagcatgcactttatcttccgctttcatcaccaacgatacattactactacttccgccgtatgaaatcatccgtacgggaatatctttcaatgcattgatgatgcgtgcctcaaaaccgacattttgccattccaggtcaccaacaacacaaacaatcaccatattcttttcgactgtaatcgttgcgtatttccgtaatacacccacaatctcgtctatatgcttgtcatcatcaatcgttacggaaaccccgatatcggaagtggtcaccatgtccaccggcgtattgtaattatagaacgtatcaaacacgatgctcagaaaatgaggtgtcggtatcatatggagcgacttgatcttgacatacgtgatgttgtctttggcggcaacagctttgatcgcacccttttccgccgtgttcgagatcaatgtacccgacgcacttggctgcaatgcgttcaagagacgtaccggtatgttcttttccttggcaggcaggatgcaagtcggatgtagtatcttggcaccgaaatgtgccaacttagcggcttcgtcgaagttcaactgcctaacaggagcggtgtcattgacaaaccgtggatcgttgttgtgcatcccatcaatatccgtccatatctgtatctcttctgcttggatagccgccccaattagagaggcggtgtaatcgcttcctcctctttccaagttgtcaatgctgccgtaagcattccggcagatgaaaccttgcgtaatatatatttctgcctctttgttttgctccaaaagtgtatttaggtgtttagcgatatattccatgtccggttcattgtccattgtaatccgcatgaagttcaacgcaggcaataaaactaccttcactccttgttcttccagatagcaggtcatcagaaaggttgatattagctcaccctgcgccaagatttccttttcatcgaacatgctgaaaggcatattagagaaagaccagacatgttgagaccgttcgagcatgtattgcatggctttttccttgtagacatcgctccggtataattcttctatatgattgacataagcctgctccaaggaagaaaggaccgcattggctttttccggatctttcttatggaagcactcagatatctccactaaagagtttgttgtccctgccatggcagagagtactactattttctgttcctgatcgcaaatgattgatgcgacattcttgatccgctgggcagaaccgactgaagtaccaccaaattttaatactttcattagactatctgatttttgattttactttttatacattgaatctgatcacgaacgtgctacctttaccgacttcgctttcgatacggatcgtaccaccatgagcttccacaaagtccttgctgatggcaagtcccaaaccgctaccttgtacttttgttcccggcacacggaaatagtggtcgaaaatactttcgtggtaacgcgagtcaatgccctttccgaagtccttgacatagatctcgacggctttgtcgatctgtcgtgcaccgatgataatccgtccgttctccgacgaataacggatggcgttcgataacaggttggtcacaacccaagcaatcttctcgctgtcgacaaacaatttggcaatcttttcgggatactccacttcgatctgacagttaaaacgctcggcctgtacccggttcgccttgatggcatagtcgatcagttcgatcggtttggtaatcttcggattcaggtagagcttaccgctttctacctgtgacatcttcaacaattcgccagtgatctccagcaaacggtcactattttcctttatgttcttggaaaggctctcctgttctgtattcagttttccgatccgattgtcttccagcaatctcagactcatcattatagctgatatcggtgtcttcagttcatgggagatcgtcgaaataaaggttgtctttgcaatatctttttctttaaattcggtcacgttcttcaacaggatcacatccccgacatacttactctccagtccagtctgcctgttaacgttgatcgggatgtattttacttgaaaatagctttccttgttgtctgcgtagattttcaacggatccttattgtcatcgggatgtaccaactggcggatcaaacggcgcagcagatcattttttaacgccacttcgggagccggtttgtcgataatgttttcccgtgtcaaattcaaaacagtcaaagcctcgtcattgacaaacaaaatcttccgttccttactcaagcctatgataggttctgcaatgctgttgataattgtttctatatattttttcccttgcaggatatcttccagcgaactgttcctgtattcggccaagcgctcggccatctcgttgaacaacgtggctatttccttaaactccggttcattgcccaaattgagccgtttgctgtaattggcattggtgatttccttgatgccatccgtcaatttctggatctgtacgctgaccgagcgtggcaggcgagccagaaagaggaaggcgatcacgatacaagcaattcctaccgtccagatccaaaagagagacctttccgccgtatggacagccacttcattcttttcataaatggcagacatattgactgccataatggtataaatcgtctggcgtatctgccgaatcgattcatcatccatgtcatccaacgccttttcacagttcgaacttaatcggttggttagtacgtcttcatccttctctgtcagattttttttctgagcttccaacccggcctcaaactcttttcgagcattcggattttcccgaatggcatccagtgactcgagcatctgacgggaataaaggagtgaattataattatccgctaggatattctgcgtgtcatccgatacattatgaatgttttttatagccaatccacctaataaagtgatcaggacaaataaaagtcctatcccataagtcaactttgtttttatattcatattcatggaaggatttttatgctaatattattaaatcaatgcctaattgagccaactcttctaacatgttccgatagtggaccatcgcaaggatagcggaaggatattttaaagctggtcgtccgatacatagcgtactgatttgcttttctttacaagcctgtacgatcgcatccgttatatgtggggattgcacttgaatgatttctcctccaagttccgttgccaacttgaaatggttaagcaaatgcctttgacttgccaacggaatcctgtcggaactttctcttggggtttgtacatacagtacaaaaaacttggaattatatcgggttgccaaccgtgcgactttccgtatgatcttacggggagttttctcattactgctgatgcaggccataaacctttcgtggcgtacgccgagattctctggaatggtattctccacttttttttctacccgcaaagctacctctttcaatgccaactccctaagctgaagaatatgttcagccttaaagaaattatttaatgctgtttgtatcttatcgggtttgtatatttttccggcttttaaccgagccagcagttcgtcagcagtaaggtctatgttgaccacttcatcagcctgctccagtacgatatcaggaatacgttccttgacctcaatgccaaccacgtcctgcaccatctcgttaagtccttctatatgctgaatattgaccgccgtgatcacactgataccggcatccagtatatccatgacatcctgccaacgcttttcgttcttactgccttcgacattggtatgagccaattcgtcaacgatgacaacttcaggatggatactgagaatcgactgcaagtccatctcttcgatctcttttcctttataaaatatcttgcggcgggggatgataggcaatccttccaccaatgcctccgtctcgactcgcccatgtgtttctatataaccgatcttgacatcgataccgctttccagtaattggtgggcatctgatagcatccgatacgatttacctacaccggcaatcatgccgatgtagattttaaaattgccacgacgagactttttcaacaaatctaaaaaatgttgtacactttgttctcggtccatgcgtattattatatcaaggtcttaaagaaattcccaagacaagatgggcatcctccatgcgagggttccaaattgcctgtgtaaaaataggtaatgagaaagaatccgtgattttgatatctttcgttgctttcaatgcaacattcgttactgcaaatccactatttacatcacctccatacgtagttattcccgcatcatacggaagaacaccacaagttgcattcagatcgacgcccttcactgtgaatggaaaattcaactccacataagaagaatagttttggtttccattttcatctttgtcttgaccggcaaacatgaaattccaggcgatagacaaaggtaacttctcaataggcaaagtgtaagccaaacctgcttcaaaatggtgatctgtttcatggcttttgaagttaaaataacggcaagagccttgccctgcccaccataagctagcgacagataatgtaggaccagctgatccgaatgtatacgctgccgttaaatctatctctttagccgcaggcatagatgtagagtttgctccctgaaaatcggtagatccccaggctgtcaaagagaaattacctacccccagtgatagtgtcggctggaagctagcaccagtctggtagaaaccacgccaaatataggaacttaccaaatctccctgcacagaaaaacttactttaccatcctcttcctgtgcattagccaacgtagaagatgccattgagaatacaattgccaaggctgctactttttttacgaatgatttcataacctaaatctaattgacttattaaaatttgttatttgttatttgatgcttgatcaagcgcaacatttaatttcaatacatttactttctccattccgaacatacccaataacggtttctcaacatgagaattgacgatacccatgaccttttcttccgaccatccacgagcgtccgctacacgtttggcctgtacataagccgctttcggtgagatatggggatccaaaccggaactgctggctgtgatgatttcagccggaactttttcacgggttaggtaaggatgatgaaccaagaatgtatcaatacgttcttccaacaaagctaaatgttcttcattggaaggtcccttgttactacctgccgaactggatgcatcgtaaccatcaccagcatgggaaggacgtccccagaaataaatatcttgcgtgaaattctgaccaacgttggcggcccccactacttttccattcaatgtaaccagttcagcattacctttattcggtcctgccacttgggcaaacaaccacaaaacgaagatgtagaaaacactgaagaacaaacaaaatgcaattgtcagtcttaatgatttaaaaagatttgatatcataatgaattattgttttattttcttaaccttcctcctatcttcatacagagggaggaaggtttttaatattgattttacttttacatgaataaacttacaatcatatctatcaacttgataccaatgaacggggcaattacaccgcccaaaccgtagatcagcaagttgcgacgaagcaatgcggaagcaccgatcggtttataagccacaccacgtaatgccagagggatcagaatcgggatgatgatcgcattaaagatgatcgcacttaggatcgctgattccggactgtgcaggtgcatgatgttcatcggggccaatgccgggatcgtaaccatgaacagagctggtacgatagcgaaatacttggccacgtcgttagcgatactgaaagtagtcagcgtaccgcgagtcatcagcaactgtttaccgatttcgacaatctcgatcagtttcgttgggtcgttgtccaaatcaaccatattaccagcttccttggcagcctgcgtaccactgttcattgcgacaccaacgtttgcctgagccaaggccggggcatcgttcgtaccgtcccccatcatggcgaccagcttaccgttttcctgttccttacggatatagttcatcttgtcttccggtttggcttcggcgatataatcgtctacaccggctttttcagcgatatattttgcggtcaacggattatcaccggttaccattaccgtcttcacacccatcttacgcaaacgttcaaaacgttcttggatacccggtttgatgatatcctgtaactcgatcacaccaatgatgaaatcatcctgtgaaacaaccagcggagtaccgccgttactcgtgatcttctgaaccaaatcggccacctctttcggatatttgttgccggcagcctcactcatcttacgaatagcatcaaaagctcctttacggatgcgagtaccgtttgccaaatccactcctgaacatttagtttctgccgtaaacttgatcatctttgatccggatgtattcagatcatgtacacgtacacctttttcacgtcccaattccacgattgacttaccttcgggtgtatcgtctgaaagagaggacagtagacaagcttgtacaaaagagtgttcgtcaatgccggataccggatagaactgggttgctttacggttaccgatcgtgatcgtaccggtcttgtcgagcagcaaagtatcaatgtcaccggctgtttcaaccgccttaccggatttggtgatcacattagcagacaacgcacgatccataccggcaataccgatggcagataacaaaccaccgatcgtagtcgggatcaaacaaacgaacaaagagataaaggccgcgatcgtaatcgtcgtgttggaataatcagcaaacggtttcaaggtaccgcaaacaacaacgaataccaatgtaaaacctgccagcaagattgtcaaggcgatttcgttcggagttttctggcgagaagcgccttccaccaaggcgatcatcttatccaagaaactttcacccggttcggtcgtcactttcaccttgatctggtcggacaatactttcgtaccgcctgttacagaactcttgtctccacccgcttcacggatcaccggagcagattcacctgtgatggcgctttcatcgatagaagccagaccttcgataatttcaccatcggaaggaatcgtgtcgccggcttcacaaataaagatgtcgcctttcttcaactgagaagaactgaccgtttcaatcttgttaccgacacacaatttggcaggagtttcttcccgggtcttacgcaaactgtcggcctgtgccttgcctcgtgcctctgcaatcgcctctgcgaagttggcgaaaagcaacgtggcgaacaatataataaacactaagatattgtaaccgaaagatccttgtgtcgtatcaccggtggtagccgcccaaatcgtaacaaacaacatgacgaatgtcaccacctccacgataaacatgatcgggttacggaacatcatccgcggattcaacttaatgaatgattgcttcaaactttctataacgagcttctttggaaataaagaagcagttttgttatttctcatcttcttaatctgtcaattagtaaatactaaaatattcggcgatcgggcctaatgtttgtgccgggaagaatgacaaggcagcaacgatgacgattacgaagaatgtcatcacaccgaatgtaaccgtatcagtctttaatgtacccgcactctccggagtgtacttcttgtttgccaaaagacctgcaatagctacctgtccgacaattggcaaataacgtgaaatgatcagtgccaaaccgcaagtgtagttccagaaataggtattgtcgcctaatccttcaaaaccggaaccgttgttagcagaagaagaagtatattcatataacatttcactgaaaccatggaaaccagggttgttcaaccagccaccctcgctctctacgaattcaggggcatatacccatacgtaggaagagatagccgtaaagatcaaaatcacgaatgggtgagccaacgaaacgatcgttgcaatcttcatttctcgggcttctacctttttacctaagaattccggcgtacgtccgaccatcaaaccgctgatgaatacggctataatcaagaatgcatagtagttcatgaaacctacgccgacaccaccaaaccatgtattgatctgcatgttcaacatctccaccataccagaaagaggcattgtactgtcgtgcataccgttaacggaaccattagaggtgacggtcgtagtcacagaccacaaagcggttgcgcccggacccagacgggtttccttaccttccatagcaccgcaagactggtcaatacccatctcgtcgattttcgggttacctgccatctcatagtgaacgttacagaatacccccaaaagataagcaaacagcatcacaccatagatcacataacctaactttttacgtttcagataaaatcccaaagcaaataccaatgccatcggaatgatcagaatagaccaacattctacaatattggtcaggtaagtcgggttttccaatgggtgagaagagtttactccgaagtaaccaccaccattcgtacctaactgtttaatcggaacgattgcagctgtaggaccttgtgaaacagtttgttcagctccttccaatgtcgggattgtcattttggagtcaaagcccatcggcgtaccttgtatgatcaggatgaaacccacgatcagagacatcgggaaaaggatacgtgtacagctgatcactaaatagtgccagaagttgccgattgttttagttgttttggcggccatcgacttcataattccagccatggcagccatacctgttgcagcagtgatgaactggaacaacatgatgacgaacaactgtgtaaaataagtcaaaccgctttctccgctatagtgctgcaagttacagttaaccatgaaactaatacacgtgttgaacgccaaatctggactttgtccgctgttcccatcaggattcaaaggaagatatccttgcgataccaacaggatcataccccagaagaaccaaaatacgtttataataagcagagatttcaagaatgccttccaatccatctcttcattggggttgatacccgccagcttgtaaataaatctttcaattggagccatgaaacgcatgcagtcgtttccctccttatacaccttggcgatatgctttcccagcgggtaactgataaccagcagcagcaatatctgcaatgctacacctaaaatttctgtattcatcttttcacttaaaaaaactaattaccattaaaacttttcgggcttaattaggacatacatcaaatacccgaagatcaataagcaaagtataaacagtgctaaaaacataatttaattctcctttcttacattaaattttctcaaaccagtccacacacttgaagaaaaaccaatagcatgctacaccggtagcacacaagaacaaaaatgataacgtatcttccatacttgtcttttttaattgttaatactatttatttgttttccaccctactatatgccaaagctgtgccaaaaaatcgagttcttgcacaatgcattgtttatcagctatataatcaaaaaataatattattatgtaatatgctcaatccttttcaaaaggaaaaagatattttcattttgaaaaggtatataaaaaaggcaagctgcctgttttaggtaacctaccgggtatgcaagaacaaagtgttccacattatagtccataggcttccatcttcctataaagtgtggttaagcctatcccaagaagacgagctgcttcgggtttgtatccgttggtatgttggagaactttctgaatgaggtgtttttcaacgctgattaggtccaattcaatattattcccgtattttcagataattaacatttcctttccatggacatcgttttatggctgccatatattttttatgatcactttaaatctcaccaaaatctttagatatctgccctgcacagacaggcttccaacaatcgaaatttctttttttagctaaaatcgtgttattgattataggcaattcgcaactttcgctgatatataaaatagcatgtccctgagctgttgttttcaattgttttcttaatgtgttccaagcttctgtatcagaaataaaatattgcgatgcggtagactccgtttcatacaccagtttgtattcattcagcaccaattcattttcctgatttgtcttcttttgaggatagcataaataggcaattcctgtcaaaaggatgattcctgtaaaagtattcagcagatatttaaaataataatcattttcgaagaaatagaattcattgatgctaccacatatacatacgctagccactaacagtaatattaccgttatccgttgcttcaaaaagttcatccgcatattctttttcatttgtatcctaatttttgaaatcaaatcctttaaataagccgtgaataaattatatccacggctcaaaaagaaaaaaacaattcaaatctttacataatgaatggagaaaaagattttggtacacataaaacaactttaattgcaataatatataatatgaaacttatatccttctatgggcaaccaaatacttcttgcaaggccaccatttttcaatcctgtttttcaaaatgaaaaaatatccaaaaacaccaatccagcttgttactagtaacagaacgataatcttgtttttgatcctttgaggaacatctttttttattaaattgctgattgcccatacagaggcaagcgagcctaactgataaataaaaaataccattttgtttctttgttgttctacattgtttcttatagcagacaaccgaagatgaatattaatgatactttcttcggaaatctaaactgataaagataatgccaaaatcagaccaatttaagaacaataaacataaatcgctatatatcaatcgattaaaaataccaattctaaattgaaagtaaaaaaaaccaactaaaatgaaaaacactttttcattttggtaatattacttaggcttccctatttgcaaacatctgtttatcaataacaaatacaaattggtatggattttgctttgtgttgtatataatatttcaaatatgagattatttatcatttcgaataggttgcctgtaaaagttacacgttcctccgatggaaaatttgttttttcacggagcgaaggagggctggctacaggtttgaagtcattggacgttgattgtgaaaaacattggatcggttggcctggcgtctgcgtagaacaaaagacggaaaaagatgacatttgcagtcaattggaaaaaaataattatcatccggtattcttatccgacaggcagtatgaaaattactacgaaggatatagcaacagtaccctatggcccctctgtcattacttttttgcttatacgttatataaaaagaacttttgggaatcatatagggaagtcaatgctgttttttgtgaagagatatcgcggatagttgaacctaatgattgggtttgggtacaggactatcagttaatgctgttgccgggcatgctccgtgagaagtttcccaaccttcatatcgggtatttccaccatattccgtttccttcacatgaacttttccggattctgcccgaaagggtcgagatcctgaacagacttttgggagccgactttgtcgcttttcacattcacgattatatgcgtcatttcatcagtgcgacggaacgcgtccttcataagaatttcaatctggatgaagttcaaatgaatgatcgtgtaacccgtgtggatgcattaccgatggggataaactatgatctttatcacaatgtgatagctgatgacaaagtccaccacgcagtagagaaaacacgacttctatttggagatcataagttaatcatatcggtagaccgactggattacagcaaaggaatattgcaccgtctttacggattcgcctcttttttgaaaaatcatccggaatatcacgggaaagtgacattggcgatggttatcgtcccctctcgcgaccatgtaggcagttatgccgaattgaaaaccaaaatagacgaggagatcggttctatcaatggaacttactctaccatgaattggactccggtatgttatttttatcacggtttctcttttgaggaattggtagcgatgtattatgttgccgatatagccttggtaacccctttgcgcgatggtatgaatcttgtggcaaaagagtatgtcgctaccaaacaagataatccgggggtactcattttaagtgaaatggccggtgcttcggttgaattgtctgatgctttattgattaatccaaacgacacggaccagatcgaacaagccatttgccgtgcattgaaaatgccattggaggaacaaagagaaaggcttcagcgaatgcaagccatcctttcggttcaaaccgtaaacaaatgggctgcggatttcatgagagaatggcggcagaccgcagagaaaaacaaacgattacaaaagaaaaagatctccgcacaagaccagaacgaaatcaaaacattatatgaccaagcgaaaaagcgcttgattttgctggattacgacggaacattaactgcattcaaaaatcatccggaagatgcagttccaacacctgcattacgagacctgttacagcgtttttgttccgactctcggaatcatgtaaccattaatagcgggcgggaccactatacattggagaaatggctgggagatcttcctctgtcttttgccgccgagcatggtgcattttacaaggaaaaaggcgcatggcataaaaacataggcaatcgagagtgggattcggagctattgtttattctaaatttgtttgtaagcaaaaccccgtactctcatcttgagacaaaagaagctgctcttgcctggcattatagagaatcggacgcctggctgggagagctgagagcgcaacagctaacaaaggctataatgcctgtttgcctgaaaaagggattacaaatcatgcagggcaacaaagtcgtggaaataaaatctccagaatgcacaaaaggttcggaagtagatcgcctattattggcttcccgctatgattttatactagcaatgggagatgacacgacggatgaggatatgtttcgggctcttccagtatccgccataacagttaaagttggaattgtatctgaaaaagccaaatacaatctgtcctcgcaggaagaagtattgccttttttggaagaactgtcgggtgaaggtgttagttacggaacgacttccaaaagcataaaaggtcaactgaaagccaccgttgatttttttaaaggattgtggacaaataaaaaataatttttatggacaagttaaattacggagtaataggaaattgctgcactgcggctttgatttcggataaaggcagtatagattggttatgtttccctaacttcgactcaccttccatctttgcatcattgctcgatcgggagaaagggggatatttcggcttcgaggtttctccggattatcaaatatcgcaatcgtatgttcctcatacaaatattctttcgaccaacttcgtatcagaagaaaatgaatttgccgttgtagatttcatgccttgttaccatctgagcgatgcgagcaattgttatcgtccggcagagatctaccgatatatccgcagaatcaaaggtactccccgttttaaaatcaactatgagccggctccggactatgcccgtggaaagacaattttcaacacgacctcggaatatatagagacctactctacttctaacagcaaagataggcaatatctttattcctcactacctttgcacaacatcttggaacagaaagaaatcgtactggctaaggacgagttcttgctactttcatataacgagaaagtaatacccgtcaacattgagcgtgagaaactggaatactgccggacgctggtttattggttgaattggactgaccgaaccaagaagtttacggtctataacgatatcattgagcgaagtctcctagttttaaaattgatgtctttttataatggagccgtattggcggccataacaactagcctaccggaaacgatcggagaagtccgtaactgggattatcgtttttgttggctgcgcgacgcctccatgtccattgaaactttgttccagataggccatgtggaagccgcaaggcggttcatgagatttgtccagtctacttttgtttctcaacacgatacttaccagatcatgtacggtattcgcggagaaagaaaattgacggaagttattctgggacatctttccggttataagaactcacgacccgttcggatcggtaatgatgcttaccaccagcttcaaaatgactcgttcggctatttaatggacctgatctaccaatactatcgtttgatgcccggtacattggacgaggtggaagatatgtgggaaatggtaaaaagtatcctgacgaatgtgatgattgactggaaaaaaccagacaaaggcatttgggagattagaggagaaggacagcattttgtttcctccaaagttatgtgctgggtcgcattagacaggggagctcgtattgcagatttattaaacaaaccgacataccggagacgttggtcggaagaagcgaccgtaatcaaagaaaatgtcatgaaaaacggttggaaagaagagatgcaaagtttctcgcaaacctacggtaattccgaccttgatgcgtccttgttgttaatggaaccgtacggatttatcgatccgagagacatacgctaccataaaacagtgcaagcgataaagaatgcgttactttataaagggttgatgtaccgttataaatctcatgatgatttcggactcccctcttccgcctttactatttgtacgttctggctcatccgtgctctttatgtcattggagaaaaagaagaagcacgtagtctgtttgaggaaatgcttcataattcaaatcacttgggacttttcagtgaagacattgattttgaaaccaaggagcaactggggaattttcctcaagcatattcccatttggcactagtcaataccgctatattgttttcggaagaggacatacgactgtcttttaaataaaccttctgtatctctttcattttggaaatattttttcactatgaaagagattttattctatttttataggacaaagctcataggaatcaatatggaaacgaataatttactggccccattattttttgtattgatagggttgatgggaggtgcgattttaaaattcggattaaaaaagatgcctcttccttacacggtcgggctatttgcctttggattattgatcggtacgtttgaccggataggctggttggaaagcattcctatattaaaatcatcgatcgatcttgccggaaatgctaatcccgatatgatactttatatttttcttccgatcttgatattcgacgctgcttatgaactggacgtgcatatctttcgaaaaacattgacaaatgccactatattgtccgtaccgggtgtcattattgcgatgttgctgacggctgccttgatgatagggatcggaacgttcgccccttcttatgaagggtggaactggacctttgcattgatgttcggagccttgataagtgagacagacccagtggccgttgtcgcattgttgaaagagctaggcaccagtaaacgtttctcgacgctagtcgatgccgagtcgatgctgaacgatggaaccggtattgtccttttcatgctgtttttcggagcctataccgctactggtgtttcggattctcccgtagcggactttatcatggtcgttgccggaggagccctgcttggtacgcttttggcttatttgtgtattcaatttatcacaaaagtaaatggagacgagatgcttcaaaacagcgtgatgattctttccgcttatatgacttttgtcatagcgcaaaattatttggaagtatcgggagtaatcgctttggtcggtttcggtttaacagtctcttacatgggccgtccgaggctgaaaccgcaggtcaataaattcatgcgtcaattttgggaattggcagcacacatagcaaatacattgatattcataattgtcggtatcgtaatagcattgaaggtagacttctcatggatggatttattgattcttatctgtgtatatgccgggataaatatcattcgtatattaataataaccatattttatccgatcatgaaacggtccggatatggcttgtcggtgcgagagtccacgatcttgagttggggaggattacgtggtgcattgggactaacgatggcactgatggtatcgtataccttttcgataccagaaccaatacgtcggcaagtacttttccttacggctgggattgtaactttaacattgacaataaatgcgactacaatcggttggcttctaaaaaaattgggattggcagagataccgtcctccaagcttcttttggattatagcgtaaaagaacagttgtacgaaggttctgaaaaatacctaaaagatttgaaacagaaggaagcgttggaagcaacagactggagtattgtcgaacagtttctacctcaaaaagaaatatatccggaaatgcctgtccgtaccaaagacgtaatggcagacatacgcctacgaatcttggatagagagcgctcgctctattggagcctatacacaaacggtgtcatttcatccgggacgcaaagacgtttaaatgccgcaattgatgaacaatacgatcgagacggaaagaaacctctatgcgaccgaggcgatatttttgaattctgtgaggaaccttcatggataatcagtatgaagtttttctctcgttttttccaaaaatgggcagatatttactatcaagacagaattattttagggtacgatttggcaaggggattgatcatagcccagaaagagtccttgaaactggttaacgagtttggctcctcggaaacagtctctaccgaatatgaaagttgcttatcgcttttacaagtcgagatccgtaaaaatataactagagcatcgaattttatcacaaaaatatccattgattatcctaaatcatataaagaggctgtgactcgcaagtctgtccgtatgttattgagcaacgaaaaaaagaggatagaacaattcaaggaacagggtttgatttcccaagaagaagccgagcaaatggtaaatgagttgggagaacgtcataataagtttttcacttcttaccagttcctaaaatagcgaaaagagaaatatgtcagtcatcctcaatagataataactcatctaaagcaccattcataatgtatggtaaacactggcgaatcttgtctataggccaatcccactatttgaggatcttgtataatggtatttagatatacggtttgtttatctcccgtacgtggatatattttagtcatcatctttcttcgttttttagtaatgtttctttttcaaataaaaaatagattgtgtagccaacagaattacaaagacgtattccgctgttaaatagattgcgagaggagcttgcgtgtagcgacataactaataaagataaaccaaatatatggttgttgtcgtaacttgaaaaaggaaagtcatttgtgtctttcctgttcctccgacagcattcaaatatacataacccggtaaagcgaaagtgtaattcaacaacattacaacaaaaggggcaaaagctaattgtatcaatagttcattactcgtataaaaaccaataatccatcgattacacaataaagcaatcgcaaccaagggaaatcctatggcataacctaatttcagaattttactacagattgaaaatagtgccttcccttctcccgcaccaatcgcattactgactaatgagcctgttgtaagcgcaaaagaattcgctatcacaaaaaatatagccgatacgctccgggttatattggaaatcgctaactctatttttcccaaatgttcaattgaaacgaaaaacaagaaccaaggggctacactaataaacgcatgaagcatactccatgttgataacttcaagacttttataagtaaattaccattatagaccggccttaacccatatttttctttatccaatcgtatccacatatagaaggaaagcatcataaaggagcccatctctgccaaagaagaggcaattgccgcccccgagattcctaattccctagtgaatatcaaataaaaatttaaaggaatattgattaataccgctatggcagcagcccaagatagagcttttgtatgcgttatccccactaaaaaagaacgtatcgctaaaaatgggaatgaaaacaacaatccaaagctacgccaatccaagtataggattaccgctcgataaatatccgaggaaacgatcagcttctttaatataaatggggaaaccgtatgaatgagaaggtaaagaaagatagccaatcccaaaaggaaaaataagccttgaaaaaaggtcttgccggtttccttgtaatcttgctctccattccttcgagctaccattacttgcaacccaatgctaaacccaaaaccaagcatataaatcgccaaataataaattccggcgatagcggacgctcctaattctatctctccaacgtggcctaagaaaacagcatccgtaatattgattaattgttccattaagatgctcatcattacaggaaagttgatgagccatatttgtttatatgtataattcattgctcaactgtataatagtgcgatacaacataccgcttttatgcagtatgttatttcgtaatccataaaataaaaggatataaaatctccgtgacaaataaagctgtatctgtcaaatagctgaatagctttattggatagggctaaaagaaaaaacggctaaatagacgtctctatccaaccgttcaaaagatcttcgcgataatcttttgtgctcacagtcaaggttaaactcgaaaaacatataacttcaaaatgaatttataacatcattttgttttgatgttggcaaaggtaagcctttatttgtaaataacaattttttatcatgttttttttactattatatcttttttttcttctctagaatattttcgttttaatttatggcctctcttgtgctcggatattcaaaaaaacgcaatggaaagttcaagagatgaaagcagggcataaaaagggtgtgtcatgacacaccctcttgtgaaaccataaaaaggattttcagccacaatggaaataagtattgaccagcttcaacatctcttccggattattctctaggtccttgcgtaaagaagcgtcatcataagattccagtttatggatgatgccgtctatcatactcggactaaacacattatatttttcaaaaacagcacgctgttgtcttaaacgggcggctgaggctgcgcaactgtctgggagttgatccaatgtctttaggcgatcttgattctcttccttatgaatattcacgtttacataagtcttctcagcgatctccaaagcatcgtcgatctcaaaaccatggcggcacgcaactgccaatcctgccaataattggtataaatcagcggagccatccggtgagcgcatctcgaccgtttgcttttggctcgtatcataatggctggcaggttccaatgggttcgccaaagcacacatgtccgtttttgcggcccaacctagcggaacacggactaaaactgaacgattccgatctccccaacaaatattcgtaggtgcttcttggtgtggaaccaagcggaaatatgaggttgggttcgtatttccaaaagccgtaatagaggaagctaagcacatcattccagcgatagccttacgggcggtttcggataagataccattcgctaacatctgattcttgccatctttcatgatacgcatatggacatgcagaccggaacctgcttttcccaccgtaattttcggagcgaaagtgatgttatatccatattcatgcgctagattgcggatcgcccatttagcgatcatcaattgatccgctgcattttccgcaggacatggtaagaactcgatctcattttgctcatagatcaaaccatttaacgtaaagttaccaacttctgaatgaccatatttaatttgtcccccggcttgcgctatgcagtgcatgcactccgtccggaactcattgaacttagcgtaaggagcggattcatgataacctttttggtcggtagcagggaaaacgccttcatccggtgcgattacgtaatattctaattcacccattgcctcaaaatccattcccgtcacctcatgaaaagccttacaagctttatgcaaggtatattccggggaactttctaagggttctccatccttattgaagaatgagcaaagcatggtaagcgtaggtaattccgcaaacggatcctcgaaagccgtacggaaacggggcaccacatacaggtcactacttcccgcctcgataaacgagaaaagactagagccatccacacgctcaccgcaagtcaagatcgcatccagataggccgcattgttgattacaaagtttagtgttttcaaacgtccgtcgcctgcaggatacataaaattaaccatctggatatctttctcatagatataacggataatgtcctctttcgtaaactcggacgctggcttttgtaaaaactccactaatacgttgggagtcatttctagttctttgttcatgtcttatattgattatgtttatagtgtagagaaaaactttcctttggaactgctaaccggaatcaagctagagatcgcttcagcaacctctataggtcggtcagactctatgatgtccacgccttgacggatgatcatacggtatgcttcagcacgactttcgggtgtggatagtttatcgtcggagggagcggtagatatcatgcacatgacacctctttcatgtaacatatcgatcacctcacggacttcgggggtaatcttaggtcctacgtaagccatgatatgattccaaggtataccgttatcctcatagtcttgaaccgcctctttcgtttttacaaaagcctcaaacatgaaattcggatttttctcgtaaaagaaacgagccgaggcaccatcatgaaccgtaatcattacataaggttccgcttgcatatcggtaatcaactgagcagtgcgctccataggaacatccttcttatcaaggattaggattgtttttccacgagcccaacgaatcgcttcctctaaagtcgggatacgatagtttgtgatatttccttcgggatccttcaaacggaaattttgcaattcttcccaagtataatcagaaactttcccggtcccattactggtacgctccagtgtatcatcgtggaaaaggacgataacactatctttggttaacctcggatctatctcgaacgtggcaggagtataagagagggtattttcaaaggtttccatactgttctcaggatagccttttccccgtccacctcggtgtccgctaattaaaggaattcggtcatccgcatattggtagaaagatatcaaatcatctacatttgatatctgtagcgtattcattccgttgtattcaagctcctcctttggcgtgttcaatacgcaagaaccacaaagcagggccagcattaaaaatctggcggataaattgagtttcatttcacgatcgtattttaggtgaatgattctttctatccgccaaacttacacaaaataaatgattttacagagttagcaccttaatattcgtcaactttctggtctacacggaacttatccaaacgtgcttgcaggcgagtttggatatcggcatattccggattatcgtataaattattcagctcattcggatcactttgcaaatcgtaaagctcgttgcagctaatcgcatcattatgctcattcttctctccatagaaatggatcaatttataacgactgtcacgcacgccatcgtgacgacgtaccatatggatagctggataatcataataatgataatacagatactcgcgccaatcttttggagtctcgcctccaaacaaggggactaaagaagttcctaccatataatcaggtttctcgataccggctatatccagataagtcgaggcatagtcaatgttctgtactaaggctgtacattcacttcccgccttgattttagcaggataacggataatcaacggcgtacggaaagattcctcatacatgaaacgtttgtcgaaccagccatgttcacccatgtaaaaaccttgatccgaggtataaacgatcacggtattatccataagcccttctttttccaaataggcgatcaaacgccccacctcatcgtcaatagatttgatgcaacgtacgtaatccttgatataacgttgatatttccatttaaccaaatcctcgcctttcaggttctcgttaatgaatttttcgttgcggggcttataagaagcgatccaagcctcccgttgttccggggtcatacgatccaaagaggcctgccagccatcaatattccattcctttttataagcctccttatctttaagctcatctaccttcaaatcataaaccaaagtcatatttttgtctatactcatctcttgtgtacgtgcggcatcgcaacgagtggcataattatcattgaaagtatctggatatgggaactctacatcctcatataaatccatatattttgtatccggcatccagttacgatgtggagccttatgatgaaccagcaggcagaaaggcttatccttatccctctcttccaaaaactcgatagcgtgatcggtcgtaagggtcgtcgcatatccctcttcttttacatacttgccattcgattctttgcttttaaactccggattataataatctccctgatcccataacacatgataataatcaaaacctttcggttcacattgcatatgccatttaccgacaacacctgtctgataaccgtgctgttgtaagatttcagagaagaatacttttgtcgtatcaataccttttcctaattgtctttgtccgttttgatggctataaagaccggtcatcaaacatgcacggctaggagtagacagagaattctctacgaaagcttgccggaacaacattccttccgcagccaaacgatctaaatttggtgttggtgccaatttacctagcgcatgtccataagcgctaatagtttgatacgaatgatcatccgtcatgatatgaatgatattgagcggcttctctgccacttctttttgcccggttccgcatgcggagaataaaagggcaggggctaatatagctccataattaatagtatttttcatatataattattttatgtaacctacttcccgacgattcaaacctatttgtcccgtgagatcatctcccagatccaaccgagcctcttctgctatagattgtaatagacgaaccacctccggatattgatctttcacatcatatctttctcccggatctctacgcaaatcatataatcgtactggctaattgattgtaaacagtacctctaggaatcactcctttccaacacatgatacaaggaacacgttgtcctccctcaaacgtggtagctttcgcttctctcaaacctccggtactcccggcatgattaccaaaactaaaccaaggcccattatccgacgtaaagataatcaaagtattttcatctaggtttaattcctctattgtttctagaacttgttggacactccaatctacctcaagcatgacatccccatataaaccttgtttactcttgcctctaaatttgttagatacagcaagcggaacatgtggcatcgagtgagcaaagtaaagaaaaaatggttgttcacgattctttttgataaactggatcgcccgttccgtatataatgtagtaagctcggcttgatcatccaatgtccacaattctcttattttttcatttccgtcgattaatggtaatgtcggatgccgtaatttgtttggtaaattagatgctggagtcactctattcccgtcataatctactggccacatatcattggaataaggcaacccaagatactcatcaaatccttgttgcaaaggcaaaaatggataaaggtgacctaaatgccatttaccgaccattccacaagaataacctctagtttttaatatttccggaagagtttcctcattaggggccactcctatacggccttgaggcatcaatgcctccgaaatccccactcgatttggataacaccctgtaattaatccggctctcgatgcgctacttataggttgggctgcataaaagtgggtaaaaaacattccttcagaggccagtcggtcaatagtaggcgtgttatatccagaagcaccggtgattgttaaatcgccatatcccatatcatccataaaaaagatcacgatattaggaagtttgtcccgggcttgtataataaccggggtaacagttgctaccccagttataaataacaattttctaatatcccgcattttgtactaaattaggattcaagtctatctcggattgagggatcggcataaggatcatatgctccttgatattttgcgcaatctcagttttattagcttccgctacttttgcttcatatgcactatgctctttcattcgttgaataaatgtaccggtacgtactaaatcgaaccaacgatgtccttcgtgagggaattccagccgtcgttcatttaatatagctgtacgaaactcatccttcgacataggtttaaagtttccagaatcatcaccaaaagcacgttcccgtatcctgtttaacatagcgagagcctttgtagatttgcccacctcatttaatgcctctgcatacattaatatagcgtccgcatacctgataatgtgcatatttacatcgcaacggtcacccgtttcaagcccttcaacccagaacttaccgctaagtggtatacttgatttcaatatttcaccggttttaagatgagcgaactctgttttaaaattagtcttttttctcaaatctcgattatcaaactggtcatacaattcttgtgttgggatatcagcctcattaagggcagagattcctaagctccccggaatggaatatttcggaccagcaagcgccatttcaccattatgttgaaatggaggttctttatactcaatataaagtacagcctcaataccagcctctgtatctcgaagccagttcgcatggtaatctttgtgtaaaccgaaaccatattcagattcatgctcgactacctctgccaatttatctttcgccttttggaaatcccctttagttaaatagactttaccgaataaaattttagcggctcctttgttgatacggccctcatcggaagctgaatattcagatcttaaaggaagatgttcttccgcaaatgtaagatcttctataatctgatcataaatcagttctttagaatcacgtggtccttttgaatcttctacggtcttcaagtctaagatcaaaggaacatcgccgaagaaacgaacgaggttgaaatagtatagagcacgaagtgtacgagcctcagcgatcaatcggttctttttactttcattcattttgatctctggaatcttagcaatcgccgtatttgccctagaaataccggaataacaatttttccacatatcttttacaaatgtattctgagagttaaatcgcagaaactccaagtcttgtaagtttgcgttcggcatacctaaaccatttttcatcatatcggtaggtagctctgccatcatatacatcaaacggttatataagctgtttaattgctgataagtagcatctaccgctgcctgtgcgtctttctcgcttgtataaaaattatccacgaccaaacggtccacgggattctcgtcaaggaaagaacaactgttgattccacaagagaaacagaaagctgaaaatatatatatgaacgattttttcattttgagtcgatttaaaagttatttaatgtccaatttgatgccaaacataaaggtacgggcttgcggataaccgccaaagtcctctcctgcctctaaagttgaagcgcctcgatagctcacttccggatcatagcctctgtatttagtccaagtcaataagttttgtccggttacgtacaatcgcagacctccgatatgtttccaatttaatttcgggaaactataagacaatgagactgtttttaatttcaagaaagaaccgtcttcaatgaaccgatcacttacgatattattccgattcgttgtcgctttttggtattcattacttggattcgtaggtgtccaacggttcacgagatcctgatatacattttgtccaccagtcggcgactcaagctccattgcgttataattgaaaatcttattcccatatgagtattgtaagaatacgttcaactcaaatcctctataagcaaacgtgttggtcatacctccaaagaatttcggatttgcgtctcccaatatctcccgatcgtttgtggcatcaatcttaccgtctccattcaagtccttataacgacggagtccgacaccgataggcgagggtgaagaagtttgttgagcacattctgcttcattttggaaaatgccgtcaaaacgatagccataaaatactccaattggttgaccaacgatcaagcgacggatatcactcgtctttaaatgatcgtcgtatgtacctacatctttatacgtttccccacccaactctaatactttattccggttgaatgaaatattaaaggctgttgtccatgagaatgccccgcttaagttgtcactctcaatagaaagctcgtaacctttattttggacactaccaatatttttcaacatagaatcataaccggaggcgctaggaatcgctacattatataataagtccgttgtttttttataataatagtcggccgttaaacgtaagcgattattaaatagcccaagatcaaaaccaatatcaaattgccctgttttttcccatttcaagtcaggattaggtatcctgttcggataaaatccagaaaccaattgatttccgattgtccaactattactttccaatgtagccaaggattcgtaaactccgatttctgtatttccagtgaagccataactggtacgtaactttaaattattaatgacagctttaaccggttccataaaaccttcctcagagatacgccatgccacagaacccgaagggaaaaatccatacttattgttgccaccaaaacgagaagaaccatccacacgtccgttaacagagaataaataccggtcatataacgaataattaatacgtgccaaataagacataaggctccattgagtagcagaagattccggtttatcataaatagatccggctcctaggttattatacttcatgacatcgttcacgaaattagaagatgctcccgttacggattccacattatttctttgaatggtgaagcctcctaaaatattcaaggaatgaatatccttgaatgtcttattccaagtaagtatattctcgttcagccagttaatagaacggtttacaccgactttcgcagatgcgatacctaacgattggtagatatttgacggagtatatttattttgcttcaaatacataatatccatccccaaagatactttaagctttaagtcttttaagaattcccattccgcataaacatcacctaacacacgtgtagtcgcattattgtatatttcttcttttgcggtagctaccggattcgggattaataacccggggtcgttagttggcgtatactcacccgtctcttcattcgcatagacagactggatgggattcattttcaaagcgccgttcacgactccgtcacgtccaccgacatctgttgccgatgttctactgatcgtgtgggtaccagacatatgagtgccgactttcagtgtattgaatatttgtctatcaagattcaatcgtaatgagtaacgtttgaaatccgagttaataattacacccttttgatcaaaatacccccctgagatcgcatatgttgttttgttatcacctccggaaaacgtcaattgataactttgaatcatagctggacggaaaatttcatcttgccaatttgttccattacccaatttagcgatttcgcctaattgtgtagtgttatagggcgcatccaatccatcgttcgtataggcctcattaaccaatgccgcatattcttgcgcattcatgacatcgatggtttttgctacgttttgtacaccaaaactagattcaaaagttattatatcacgtcccttcttaccactcttcgtcgtaataagtacaacaccattagcggcacgtgctccataaatggctgttgcggaagcatcttttagaatctcgatagattcaatatcagaagggtttaccgtagataatccactgatttgtgtattaccacccgtcgagccgaaacctgtcccactatatacgggaaaaccatcgattacataaagcggctcatttcctccttgtaaagagctactaccacgtacacggatagacgctaccgctccgggcatacccgaagtttgcgtaacttgtacaccggaagcccggcctactaatccttggtcgatagaagtcataggagtttgttgtatctctgttgtttttacagaggaaacagctcctgtcagattactttttttcacagaaccgtagccgataactacaacttcatcaattgtcttcgagtcttctatcatcatgatagaaagattgttttgatttttaaccgccacttctttaggagtatagccgatataggatacaagtaaagtagcttgatcgggtacctctaatgtgaaattgccatccatgtcagtaattgtaccagttgtagagccttttactactacgttcgctccaatgataggttcattcttctcatctgtcacttttccggttatttttttattattcgtaatcataggatgagaagctttctcgtttgttttgtaaataacaatatgcttttcgttaatggtataagccagtccttgagtggctagtagcctatctaatacatttgcgatattctgattattgatatttacagaaaccttacggcctagattaatctcatcgtttctataccaaaacgaatactcactctgttgcttgatcgcctcaagagcttgttccaacgtggcatcttccaaatgaagagaaatctcgttgacctgcgaataacttacggtagccgatgcgcagaaaatagtcaacatacatagtactagggataatctcataatattaacgattttatggaagtgagaaatcggcgaataacgcctaatatttaatttaaaatgcatatcttcgtattgattttaggtttgtaattgtgtcgctataattcgaactaagatcattctctcaaaacggaagatgttggtagcattttccgtttttttgttattttcatgtcgtgtctttcatattcgtatcatttttataagattaatactcaattgttttatttctcatagatgcatatactgtcacctcgcatggtgtagtccgttcgtttatctgcggtaataatccgaagtatttgctctaagttttcaccccgcacaaaatcacctgaaaaaacggttctttgaagttttgccggttcaaccgatatatgtacattgaaccgacgttctagttgcttggctatctctagaaaggttacacttttaaagtagaacttaccttctttccatgatgtatagtagtctaaatttacttcatatttcgaaaaagactgtttcatcttattgaaaagagcttgttggcccggagaaatgtacatcatgtcgtgatgttctcctagtccgacacctacttttccttcagtaagagtgacctctatatggtcatcttctttataggctttcacgttaaacttagttccaagtaccttcaccttcacgttttccgcacttacgataaatgggtggtccttatcatgtgatacttcgaagaaagcttccccgttcactttcacttctctttggcttgagacaaaagcggccggatagctaagggtagtacctgcgttcagaatcactcgtgttccatccgataaaacaatcgatgacctcatgcccatcgggtttgccatctcgaccatttggctgttttggttcttatagccttcatgatatgagatataattagagactcccagtaaaagagcaatagaggcggcgatagcggatgctttcaaccaaaatcttttacgtagattacgatggatacgacggttcacctcaaggaaaatatcctctttcatctcatcacccatttgctttatgacctcttttcttgtttccatattttgtctttcttatgatgaggagtaagggtatgctaaattcgtttaaagggattggctatttttttcgaaaaaaataatgaggaagttataaatggaggctttttcccatgagatcattatctttgtacgaaacatatcggtgaaattatggacgagaaagtgctcgagaaattgaaaatcttggccgagtcggcaaaatatgacgtatcctgcgcttccagcggaacctcccgttcgcataagagcggggctataggaagtgccgctggatggggtatttgccatagtttcgctgaggacggacggtgtatctcgcttttaaagatcatgctgacgaattattgtatgtacgattgcgcctactgcatcaaccggcgaagtaatgatttaccgagagctacgctttccgttaccgagttggtgaatcttacgatcgagttttaccgacgtaattacattgaaggattgtttttaagctccggcgtggtccgaaacccggattacacgatggaacggttggtgagagccatcaaggatttgcgcctcgtacatcacttcaatggatacatacatatgaagagtatccccggagccagccaagaattggtaaatgaggctgggctttacgccgatcgtttaagcgtgaatatagagatcccgaatgaggcgagcttgcggactctagctccggaaaaggattttaaaagcgtatttgcccctatgcgttatatccaacaaggtgtattacaaagcgccgaggaacgcaagcgtttccggtatgccccacgattcgctcccgccgggcaaagcacacagatgatcgttggcgctacggcggataccgacaaggatatacttcgtctatcatcggccttatatcagagacctacgatgaagcgtgtttactattcgggattcattccggtaaatgcgtatgataaccgtcttccggcacttaccacgcctccgctggtccgtgagaatcgtttatatcaagcggattggttattgcgtttttatcaattcaaggtagatgagattgtcaatgacgcatatccggatctggatctagacgtggacccgaagttggcttgggccctgcggcatccggaggtctttccagtagatatcaataaagcggattacgagatgcttcttcgggttccgggaattggcgtgaaatcggcaaagatcataattgtttcccggcgttacgctaatctcggttcagagcagttgaagaaaataggagtggtcatgaaaaaggctagctattttattacttgccgggaactcccgacgcagaccgtgaatgaggtcagccctgaaaccgtccggcaactattgacgagaaagagcggaaagaaagtagacgatcggcagcttatactgccttttatagattaacgcctgttttataagaaggattgataatgattatatttgtttacgacaagacttttgagggattgcttaccgctgtattcgatgcctattcccgccggacttttccggatttgttagtaaccgagggcgagccatttccattgttctatgacgaggcgatccggatttatacggacgaccggaaagcagagcgggtatggaaagggcttgagaagaaaatctccaagtcttctctttccgggttgacggtaacttggttgtcggaattaccggaagtagacctgttgttattcagatatatccgcaaagcgatcgatgctccagccacgattgagttcaatcttggtgacccggacatattggaaacggccaagatctggaagaaagtaaacaacgaacgcttgcgagtgatgcaattctttcgtttccaaaaagcggcggatggaacttactttgctgccatcgcacctatatataacgtattacctttggtattaccttatgcgcaagaccgtttcgctgatcagcaatggctcatttacgacttaaaaagagagtatggatattattatgatcttaacgatacgatagaagtccgtttcgaagagaaagattcacacttattgaccggattgcttagtgaggatatcatggataaggatgagaaactttttcaaagtatgtggaaggagtattttaagtctatcgctatcaaggagcgtttaaacccacggcttcatcgccaacatatgccggctcgtttttggaaatatatgccggagaagagataatagtataattgctattaatcagccaattacagtttttgttaatttcattatcgaaaaactaaagttttttcagcaggaaactagagtttctccattggaaaacttttgtttcacgaaaggaaatctaagtgattgattttatctttttgaaaatcaaaaagtaagggctaatttcaaaggtaacaggtaacacattagtagcaaaagtcttgctgcatattgcgtttctctgcataatttcaaatatctctatcacaaagatagtcaatattttcgggtgcaacaaatcaatcgaaaacttttaattaagggccggcattatttgctggtcctttttttattggaaattcgaaggcatatcgatactttttaaaatctaaagacaacttccaatcctgccgcattttattcgggcaaacaaaaaaaataaaagaaataggtattgataataagtgtattacagataaaaaatagggctggcggtatccgtcagccctatttttacatttcctttttcccaaactttgcggcagaaagaaggataaatgacgaacgaaaaagaacaaaagatggaagcaggaaatgaagacatcgaaatgctgaaagcattaatccagaagagcttctccgagcagcgggagctcatcacccggctggaaacggcactggatgccatgaccagctttaatggcaaacagatgctggacagccgtgacatgcgcctgcagctgaaagtctgtgaccggaccctcatccgctggcgtaactcgggcaagctgccttatttcaagctgagcggcaagatatacttctgggcttccgatgtataccggttcctccgtgaggaatacagggacgaaagtccggacatcagaaataacaaacccgtaaaaaaatcatagaagatggaaaatcaaagtaaagtcatcatgatcgagcgcaacaagtttgcgtctcttgtcaaggcgcatcgcaaatgcctgcagatgctgagtatcctggcctatgcctgcgcgacgaaggaagtgcagctgaccttcacattggaagaaatctgcgaactgctgcagataagccgtgaggaagtggaaagacaaagacaaaaaggctacatccgcttcgtccaccggaacggcatgacagtctatgaaatcaccgacatcctccggctcaagaacatgcttgagatggggggtgtctaccggaagatagacgagaaagccttcattctggaagtggcggagaaagaaaaaaaagaaacggaaccttcaatcagataataaatatgagacagctggtacacgcctcgcttttcagcgggtttggtgcggcagatcttgccgccgaatgaatgggatggcgcaacgccttccactgtgagatagatgagttttgtaaccgaattttaaattactggttcagccatgcaaaaagttatacggatattacaactacggattttcggggatgaaggggacggatcgacatcctcacgggaggttttccatgccagcccttttccgttgccggccggcgaaagggtgcggaagacagccgttacctctggcctcacatgctccgtgccattcacgagatccggcccggttggattgttggtgagaacgttggtggcatcctccaggtggtacagcccggcaaggcggctcacgtgggatgtcagccctctctgttcggagaggatcagcctgtataccgtaagcgggaggaatacgtcgtcgagaccatctgccgtgatcttgagcgtgaaggatataccgtccagccgctgcttattccggcttgtgccgtcggtgccccgcacagaagggaccgtgtctggtttgttgcccacgccgatagcctcggacttcaaggtaaggggacccggaagccaacagaagggcctgccggagatcatccgcgagatgctgctgcccaccccgacagcaacggagatacaccactggcaacgggtggaacgttggaaacgtcaggggcgcacctccatgcacgagacggaagacggggagaagaatcccaacggcctgacggacttccttgacttccacgggctgctcccgaccttggagcacattgggaggaaggggaagaacccgcggcagggcggccttcccgattcctttgcccaaactgggaggagtttccaactcaatcccctgtttgtggccgagatgatggggttccccacgagctggacggtattaccttttcttcctggcggcagcagtccgtcaagggatacgggaacgccatcgtcccccaggtaatccatgagatattcaaagcgatagaatcaacctataaacagtaaacgacatgcgcacgttagtcataacagaacatcccgagttcggcaaggtccggaccgtggaagccggaggcagggtctggttttgcgccagggacgtggcctcggcattgggatacgccaatcccaaggatgccgtcaaccggcattgcaggccgaagggggtatgcgtccacgacctcctgacggcaggcggccggcagaaagtgaagttcatcgacgaggggaacctgtaccgcctgatggcctgtagccgcctgccctcggccgagaggttcgaaagctggatcttcgacgagctggtcccccgcacgctcaaggagggcggctacctgctggaaaaagagggggaaacggacgcggaactgctctcgcggaccctgcaactggcggaggccaagctgagagagcgtgaccggtacatatccggactggaaaaggaaaacgcgctgaacgcccttaaattgagcctgcaggccccgaaagtacgttatttcgacgaggtgctccactctccaagcacttacacggtcacgcagatcgccaaggagttgggcatgagcggcagggagctgaaccggaggctgaaggctctcggtatccagttccgccttggcggaacctggctgcttaccgcacgttatcagaaggaaggatacacacggacccatacgcacagctggcagagccgctgcggggaaaccggtacggccatgcatacggtgtggaccgagaagggccgtctgttcatccactgcctcttcagcagcctgtctctcttttaacctttcgccgctggcggcaacaaaaaaagggctgttccccgttatttgggagaacagcccttgaaatctccgtcccggacctggtttatttatcaaggcatgtctaccgaatggcccgctcccctgatggagctgtaatccccccggatcactttccgcattgacttcaggatatacttgcacgtgccacgtatatcggaaaagccgaagcccagccagccgtcactgaaatgcgcttttatacattgggtattcctgatataccccatataatacatcttgtcaccgccgacctcccttgcttccacttgcacctcgtaatattcgccttcgtgctccacgcaggcttcccacaggcaggtttccgtgtctgcttccgggtaagactcccaacgtcttacgctatgctccacaatcctcatgtccaattgtttttattttacaaagtaaagcggccatcctgacctttcataatgatacaactctcattatccataacttaactttatttttctttattcccgtactcatccgggaacgggaaggctatagttttggccccctccggttttccttttccctgagtgtccgggtatcccgccgcgtctcctgctgccgtagcgtgtcggcaagtatccggatgaaatgcccgtaatcctccacgagctgctggacgcattcgagccgcagcgtgtgcgccatgttcgccatcgggcttgtactgcgggcggcgatgtcctgcctgagcaacgtgtccaggcagacattctgcctctttttcagatactccaacactttttccggactgcccgattcccttgccttctttctcaagtccctgaaacatttgtacaggtaatactccttgtacgcctcttccgcgtgtgactcgaaaaaggagaggtaatcctcaccggcttttgccgccttgttctggatcttttcgtccaggagttccattttctcattcagccggtccataaaccggaccatgcctgggttctgtctttccataccttatcgttttaatccgttcgtcctatgttttacgggttgtctgttttcctttttcatgtcctcttccggctgtccgagggaaaggatacgcgagaactccatgcaatctttcagcacctgccgcgagcattccagcgacagcgcgcggcaggtgtccgccatcgggtgggtgccgcttcccgccggcgttccgcccgtcagcctttccctgtggtacatggcgatatccccgaaatacctcttcagatcctccacgtcatccgtcctgctgactttattacgtaacaggcggtaatgcccgcgcagtagctcccccttgtacaggtacgcggctttccactcaaagaaacggcagtagtccgtagaggcggactccaacccctcgcgcatgacattctcgacggctgcgatcttgttgtccagcaatttccgtagtttgcggacgctccagttttcctgcctcatatacgttacatctttaatccgtccggcctctttctttcaggggccttcttcgttcttatctccttctggggagccttcatggacagaagccgttcgaagccagcataatccttgaccagtccctgcatacattccagccggtaggtatgtgccagattgaaaatatcgtccgtgctacgcctgcggatactcccgctgaccagctccttcaggcattcctcccgtttatgctgtatatatccatgcacctccccgggagcttccgccaccctgattacctgccggagttccccgtattgctttaccatgaaatgggacttgaacagctcctccccgttccacgcaaaatgataaagataatcccggtccagtttatcccggttctcctttatatttttttcctcgttccgtatccgcatgtccagatactcggcaagctgctccatgccgtatttttcctgttccgtcatattctataatacttttttttccactgtcacgatcgtatcattatgccacccgccgtgggcgaccaatagaatctctatgatttcaaaaccgtatttcttgcctattccaccagagttccatccgcaggtgattacaatgcctcctttttttacaattcggccgatggcctctttctgcctgcttcagtatgaagcctgggtggtttgcatattgaccgtgatccctaacgctttataacattccgcaacttgccgtggagaataaggaggatcatatagaaccgtatccacactatccggtttaaataaattcaggaaatccgtggcatccatatgaaaatcagtatcatactggggatcaatatcattcgttacgttcgcaagcctgttcccggccgcaaacggatctatggtatagccgttcgcgtatttttgaatgagttcccgaataggcttgatactgaatgtacgactgttgggcatttgccaaactctcctaatcaacatatggttccttatttttaacgatgtcggtcatatctttatcctcgatggagaacgggatgtccagtgtccgttccacgccgaagttgtccaccgccacgaagcggatcccgggattgtccccacccgtgttccggtaaaagagggtgaatacctgacggaggatgtccgtcgtgtccagccccgcgatgccggagaggtccgtcagctcgcggttcaccagtctggttccgtccgcggcgaacacctcgccgtcaccctccagctgtatgtatccgacgcggtaacgggcctcgcggtaatccccctcgcggttaagcgtcagacggatctccaccgtctcgtcgggcgcgatgccttcctgcaggtaccaggaagagagcgagaagtcgtatgcctgccgcacctccagacggtcgtcgcagccggcaagggtgcacgccagcagggccagcgcgcatcccatgatgaatgttcctaatttcattgtttccagttcttaaaagattaatcgatgatatatttcagcccgacggccactaccgtatggaagtgccctacggacgagccgaagaagacacgctgccggacattgaaaagaaaagcccagcggtccgtaaggtacgcctccatctcgaatgccggggcgaaaccgtagatgaaggcacccttgtgcagcagggtcgccccgtcataaaggagcctgccgttccggtttaccctctcataaccggccagcgcggacaggccggcggacaggaacacgttcctgcccctgtccgagaggaacgggaagagacagcccgcctccgcggtgaactgctccttgggaaccgctattttcttataggcgtaatgcttcttcacataatccgccccgaatacccagcgcgagcggttgcggttgtaacggctcagggccatcccgatttggaaattccccctcaggtgccttacgttccttccgaagtcatccacgccgcccagcctcagttcaagccccgtctgcccgggcaggtagcgttgggcggaaaccttgcccgccaaagaggacaggaaggcgcacatcattattataaacagatatttcctcatagaattactcctttatcagttcgtccaccagtccggcgtccaccaggtcactgttctcgatatggaaccgctggtggcgtccgccgcctttttcgtaaatctccacctcgatgagcttgtcatcggggatgaccaccttgtggaaagcatagacgatgcgtcctttccccttgccctctatgcgcctcagctcgttgagcgcgcgcaccggctcgatgtaggtctcctgctgtgccgttcgcttggccactttcttgtccaccaccttgaagcgcacgaagtcaatgtcgaagggcacatgcgaggagttggccaatgagatgtggaggaacagcaggtccttatgcacatagatgcccttgagcagggcctgcatcccgaactggtggcaaccgatatgcttcacgtccctgcggtccagacggtgtacggtgtacatcaggctggcgatgaccgaagggtcctcctcgccgagctcggtcacacggacggcgcttccctcagtggaggattctgtcggaaaccggctgtccatattgatgttcaacgcttccggctcctcctcgtaggagacgaggaacgaatagaacgatccgtcgcccgtgatgaccgagaagttcgtctcgccggggaaatcccggacggccgcctttacgcgcaccacgttctccacgccgtccgccttgcccgcgatgatgtccgtgctgcccaggtcgacatagcggacctccgaggggaaaaggatatgaaccgtcttgctgaagggcacgccgatcctgtagggcgtgatgtgctggccggcggtcaggatcctgactccgccctccggcttgcgctcctgcgcccggcaggtcatccccgccagcgcagccatgattaaaagaatgaatgttctcatcttgaatgattgcttaaaaattacagttaaaccttgttattgcttttttgtgaccagtaacaccttgtacccggccttcagctttaccttgaccgccttgacccgctgcgagatgaaccgtgtcccgccttgcaggacaccccgcgtgaggtccatcgccacctgctgcccggcggaaccggcgaaggagatgctgcctcccatgctctggctcacgtcccccaatacttccttggcggccgtccggctttccgatcccggcacgaagatgccccgctgcccgtcaatgtcatatgtggccagttctaccgggatgatattcccggcatattcgatgctgcttaccaggatgtccagacgttccccccggatgtcggccgtaccggtcaccaggctgttggccggcacagtgacacttccggcctgcaggggctcgagcaggcgcagcttcacccgtcctccctgctcgagggtctgattctcggagatgcaggccgggatggtgttcatccccatccggtagctgctgcccaccgccgtgttgaaaccgtagttcctctccacggccagtgaggcgacaaacgcggaatccgtcagcggctgctccagggcggaggtcgttccgctctccgcccggctgacggggacaggctccggcttttcttcctccttcgcctcgccgggcgagccttccgggttgggggtcaggtacctggcggccatccggtaggactgttccatcatccgctcgcgggattccgctcgccggttttccgcttctgcctcttccagccggcggttcagctcatccaccttctgttccaggccgccggccgtttcctgcggtgtctcgtagaaactttccagctgctccgtgatcttctcgtaagtgtccgccgactgccgtatgctgccgtttggagcggtgacgctgtccgtttgccccttaccttccaacaaccttccggcaaggtcggagagcgactgcatccgtctgtctttctcacgccggacctgctgtctttcataaacgtccgttttattcccttccagttggaccgctgccgggtccggtacgttcacgttgaatccggaaccgcccgccaccgtttccccgttgtcaccggaaggggcgaatatccagtagaggacagccaggaataccagcacgaagaccggtatgacgatgtatttcctgcggcgcaggatttcctccccgctaagccgcttttccggttttgtccctttggaggggatatccccggcttccgccggccgtgtgccttccggggcttccccggcgggcacgtgtccttcttccatgttactcttcctgttttccattctgctggggttgtttaatggtccggtaaatacttgttacttgtcctttcaggggatcgggcagcctgcgcagggtatccgtgaggctgccttccccgaagggaagctccatgcgctcccttgccggtgtcagccggccggcggcgcgcagcaggacgatacccgatgcgatgcaggtgaaggccagcatcgccacgaggatgccccgtctctgtttctcggaaaggccgtccaaatatgccttcagcctttcccttgccgttgattttatatccattttccagatattattgaatgattgattactgcgggacaccgttacctttccacggtacgcaggtccctgttttccagaatctcgaaatgctccgcaaggaacccttgcgggttgttgtccgagcggaccgtgctctgcaggcggcagcgtgtcaccagggagcgttcggtgatgttgctcccccggatgatcatctgccgggcataggtggtgacgcggtagggatagctgtcgaaatcgcagctcatgctgtccaccaccaccgtctggttgacgttcccgctgatgagccggttgtagaaacctttctcgttccagtcccggtaatacccgtacaggctcttgtcggccaggtacatcgcccggtttatattcgactcgatggccgccttgtcgggggccagcgtgaagaacagctcgtgcaggcggcgcacgtgctccctcgcttccaccgggcggttgcgcgcggcgtcctgcgagagggccatgatgagcgactttccctcgtccagcacgtagatcttctcccgctgctcctcggcgaaccggtaggacttccagacggagaaaacggtcaggagggtgcaggcggcaaggaacacgaggctgaacaggcggatctgcctgaacgaggactcgatgttttttaagctcttgaattccatgtcttgaaatgaatgaatgttattacccggttcgtccttacttcttcagcagcactccggccacgttgcccgtggatgccccggctacggccccgcccacgttggcggccttgcttgccgtgttgttcatgttccggttgtacgcccccatgccgccggcctgtaccacccagttcgccacggtagggacacagaagtatcccaccagcccgatgagcatgaacaccagatagatggccgtcgatccgtccggggagaagacgctcaggggatcctgtatcatttccatctcgctttgcagcaccagcgtctgtatcttggcgagcatcaccccgagcaggtcggagatgggcagccagaggtatacgctgatataacgggccagccactgcacgagcgtgccctggaaaccgtcgaagaccgagatcgcgaaggctataggccccagcacggagaggacgataagaaagaaggtacggatcgtgtccaccaccagcgaggcggcgcggaaaaggaactccatcaccttgcgcatgatggtctgcacgatgctttgcagggagaaggagtaacaggtgtgggacatccgctgcatcaccgcgtagtcctccccgttccagcccatgtcggcgatctccttctccagctcctcgtccgtggggttgaactccccggtcacggccaccttcaggggcatctcggaaagcagcctgtccttttcctcctggaacttcctcacgtcgaaggtctggtcgtggagcatggcacccgttccctgcacgacggggctcaggataccgttcaggcttcccagtactatcacgtcgaagaacaggatgcagatgcccaggcagaaggggcgcagcatgccgaacacgtccaccggttcggcacgcgagagggactgccacacgcggtaggctatgtagaagagcgcgcccagggcggcgatggccgtggccagcgtcatcatcggctggcagagttcggtcatctcgtcatacagccggcgcaggataccgtgcaggctgtcgaaagatagggatagtaataccatatagtctgtatctttttaaaggtttaccaatagcgttcgttctccccgtaaagtttcaggacctgctcggtctcgcccttctccctggcccgcaggtaggagacgcgcaggttctttcgggtatagtagttcaccagcgtcctgtaatgcctcatctcgcggtacaccctttctatgaggtccagccgttccttgtcggtcatggacatgccggtggggttgatgatgtccttcagcccggccacggacgcgctgcttttcttcatgatgttgttgtagccgaaggcgatggcctccagctcccgctgcgtgtagttcccgtcggtgagcatcttcccgtagttcgtcacatagctctccgagatttccgagagcatcagcacggactccttgaccttcaggctcccgctcaccagcgagttcacgctcttgagcatgtcgtagtatttccggctttgctcatagatcttcgaggcctccttgaaggtggacatggcgttctgcgccgtctcggaggtctccaccatctcgttgacgctgttcacgatgccctgcgccagattgcccgggtcggtcaccacccattgcgcgtgcatggccggtacggtaagtaaaaaggcgcacaatgcgctgaaaatttttcgtctcattgaatcgttcttttaaatgttttacaaagattatttcctgccgctgttcttttcggcggccagtacccgtatggcctgttccatgctgccggtctttgctgccatccgttccacttccagcttctcgccctcctccgtcgtgtaggtaaggtactcggctgtggaggtctccgtggcatagacagccgactgcacgcctcccagtcctattcatacctccttgtaccggcgtgaggggtcgttggcacggttgatggagaggatctgcgagcattccttgtcggtcagccccaaaagggtctgtatccgttcgaacttgttaaggtacttcctctggtccagcaggatcttacagtccgagttgttgatgatggcctccttcacgatcggggacgagatgatgtcgtccacctcctgcgtcaccaccaccgcctcaccgaaatacttcctgaccgtcttgaaaaggtacaagacataggcactcatattggccgacatcagggctttccaacattcttcgatcagtatcatcttccggatgcctttcaggcggcgcatcttggaaatgaacgtctccatgatgatgagcgtcaccaccggaagcagcaccttgttcgatgatatgttgtccagctcgaagacgatgaaccgcttgtgggtcaggtcgatctccttgtccgagttcaggaggaagtcatagtcccctcccttgtagaacggctccagcacgttcaggaacccgtcgatgtcgaagtccttctcgcgcaccctctttttctccatcatccggcggtagtcgtcacggacaaactcgtagaacccgttgaagtccggccggagttccgggttgtccgtaatcctgcggatataggcgttcactgcgccggagagggcgacctcctcggagcgtttcggcacctcgtcctcccgcttccaaagcgtcaggatcagcgtcttgatgctctccctcttttccacgtcaaactgccggtcctcgctgtagaagggattgaaggtgatcgggcggtcctcctcatatgttatgtagatcccgtcctccccgcgggtgcgctcatggatgagccggcacagccccttgtagctgtttcccgtatccaccagcaggatgtgtgcaccctgctcgtaatagttgcgcacgagatggttggtaaagaaggacttgccgctgcccgaaggccccagaataaatttgttgcggtttgtcgtgatgccccgtctcatcggttcgtccgagatatccagatggatgggcctgccactgagccggtccgccatcttgatgccgaagggcgagagggaggaggcgtagttcgtctccccgatgaagaggcaggccgcctgttcgatgaacgtatggaaagactcctcggcgggaaaatcgccctccccgccggggatacccgcccagtaaagggtcggcgcgtccacggtattgtgccggggcttgcagcccatctgtgccagggccgagccggtgtcgttccggatgttcctcagcctctccctgtcctccgaccaggccatgacgttgcaatggcaacgcacggggaccagcccgaaggaatgcgcctcgttcaggtactcctccgtccactgccggttgatctcgttggcgcggctgtagcgcgagagggagcgcatattcctggccgctttctcaaaattccggagggtctctgccggatcatctatgaacacgtacaggttgcagatatggttatggggcagcatcagccccacgggggcggcaaaggagaggcggcagtcgctgcggtcggtggaatacttctcgaaccgcccgtccgtccgcaccgcggcgggcaagtcatccgcgtcggaaagcgtatgcaccgagagccgtttgtcgccgacgcgcatttccgcgcccccgagccggatgtcctccagcgtggtggtgtcctcctgcgagagggagaagtatttctccaccaggccggcctcctttccctttccggtgatctcctccgtcgtgagccgttccagacggaccagcccggagtcgcggatgatgcgctcgaactgctccacggcttccaggaagcggaggacgccgtccttgtcgcggacctccctggggaggatatgccccctgcagaggacggagaagttgctctgctgccgcatgcgccccttcgtggtacgggtgatgaacaggtacgagaagtggttcaggaagggccgctcgttgaaatggagctcgaagctgcggtcaaggaatcccagctcctccctgtcggtgcgtgccctgtagccctcctcaaggaaccagtcctgacggtggacgatggtatggcagggcaataccctaatggccttccctcatgcgccgtgcatggcctcgtaatcgtcggaggtgagggtgaagatctccggcaggcggaccttgaagccgacggtcacgtccgcgtccttggagaggatgcacccgtcctcgacggcgagaaggggaaacttactttccagggtggacgctttgagtatgtttcgcatattttcttcgtttaaaaagtgaggtgatacgttttctgttgatgatgtagtagggacggtaacctgccgccgccagcttcatcagcccgtgggggccgtatttcctgttcaggcggaacacgcccagggtgattcccgtggccgatacgacgcagagagcgatgcagaaccagcggttcacgcccgccatgtagaggatgacgaacacgaggaagacggcgagcaggccgccggcaaagaggtagaggtactgcgccttcaggccgcagaactccacgtcctgcccgacgcccttgttcagcttgtattccatatggcatgggggttacaggaagaacgacctcagcaccgtggccgccacgatcaggaacacgcaggccccgaaccagcttccggcggtcttgcccgtatccggatcgcccgacgagaacttggaatacacgcggatggccccgatcagcccgcagagcgcgccggccgcataaatcagtttcacggcggggtcaaaatagctgttcaccatctgcgtggcctgtaccagcccggcggacccgtcaccggcggcgaacgcgggggctgctcatgtggccagtcatgccagcaggaaggctgttctggccggtatgcgcccgataagggataccaatacgtccgtcactttgcccataggggagaatcgtaaaaatgaatgggttcttgaatgtctcattgttcttataccaatttataataaatgtttgtcagactttcttttttgacaggccgcgggcatccggcccgcggcttgtccttgcaaccacatgtttactgccggcatcaaccggaatcataataaccgtacatcgttacctccttgtgttaattgtttgctactcgtgtcgctctctcttcgggacgggatgttcgcaaggatcatcccgagtcatgatacactttcatacctatatattatgtcggatttccttttttacggtctgcggacccggatgcccgcggaccgttcttgtaaccgcatgtttactgccggcatcagctggaatcatgataaccgtacatcgttacctccttctttaattgtttgctactcgtatcgctctctcttcgggacgggatgtccgtaaggatcatcccgagtcatgatattctttcatgcctgtattctattatgtcaaatttttcttttaacgggctgcggatccggatatccgcggaccgttcttgtaaccgtatgtttactgtcggcatcagccggaatcatgataactgtacatcgttgcctccttctttaattgtttgctactcgtgttgctctcttcaggacgggatgtccgccggatcatcccgaatcgtaatatccggtcatcgttacctccttctttaaaattggaccgtgccgcccggcggcttttgttttcttgggaaaatgtccgcaaagcggatcagcttgaatcatgatacttctccatacattatattattggttatcggggtatgaaatccatgatatcgaaatccctgattatgctttccctgtcctttcccgctagcaggggcggctccctgccactgtccacgtacagtcttatgtaccgtttcaatgtctcgtcgctgcctaggatgccggtctgcagaagtcgttccacgttggtcccctccagccgttccaatgtctggcgggcatgggattgttcctgttctgaaaggcggtccgtggtcatgaacctggagagcaggtccatgtcgtcaaaggtcacgcctctggcgcgatgcggatcggggcgttccacataaccggtgatctcgtagcgttccggcacttccccgtcctccggtcttccgaaaggattgggaaattcgggcacaggtaccattttctctttcgtgtccgtatccgtccgcttttcgctcatcgcgtattcctcgtccataggcggggattgccataaccggtaccggctcctgccgatgacagcttccttagacgcttcttcctgtgcttccgccggtttttcctttatcgggaaactggaggcagaacgccggtttcccctccatttaaggatgctgcccgtgtggacatacttctctatgcttaggtaggaagcatacaggaacagaagaatgaatgcgtactccataccgttgttattgtcgtttcggatcctgttcctctatcttccggatcaagtcggcatgtctttccaggtgctcgaatatcacccggctgacaaagctgcctgtcgtgacatcctcgcgtccgattgcctgcacaagcccggtcatacgttcataaactacctcgtcgatatccaggatagtggtctctgacggataggaagcgcgtcggtaggattcaatgagccgcgtcagactttcttccgccatctcttcgggatgctctttacggaccggtttcattgttacggtgcaggaaaccgcatttgcatttccagttttttcccttgtggatctgatgttttctttcattttcatatccattattttaatataattgctttttatagaattcctttatcttctcaatcaggccggctttttccttgaaatggtctatgatgatccggctggcaactcccgctattgtaaagtccttgcgacggacgatccagaccaggtcggaaaggagcctgtatgcttccttatcgatatgcaggggattacgtccgggggaagagaaatcattcaggtgggaattgatatattccccgatgtcctgttcctcagatattcccccggcttccggaagagggatgtcatcttccttacggaccggcattgctttggacgagctggagctgtatatcccttgcgcacccaaggcagccaccttctccaggatagccttctcgtcaatctgccggggattgatcttttttcttccggaactttccatactatgcgtctggtgagggtgaatacttgcccagcccggtgataccgcatatctcgtctacaagctctacaagccctgatccttttatctggcggttgtcggccggcagcaaggtagaacggaagacactcccttgcagggcactcagctccttgttataacgcttggtgtccgggatgcatgtttccagcaggtgcagcttcgaggcccgcatgaccttgttccatgattcataggtttctttgcgctcacgtttgtcgatcatgttccaaaacaggtggattcctctcaaatcacaattccggcgggcaaccagttcttcttcgactacggcggcgaactgtaaggaactctgcatcacgatattgtccgcctttaaaggaatgaaaatgtggtgcatggaggccacggtctgaattacgcctatactgcggagcgtgccgggaaggtcgaacagcacgatgtcaaactccatgccacgttcttcccggtagcggttgaagtcagccaccgcattttccggatcgctctctataatcggataagcaagtttccggagctgttcatgttggcggtaaagggccactttcagggaatcgttctccccgatacgttccatgtcacggcttctcatctgggtgatgctgtgctggggggcatcgcagtccaccacggctacattgtatccccgctggtaatgcaggataccggccgtgagtacggtgaaggcggtcttgcccactcctcctttctggctggcgaatgcgataaataaaggttctttttccattgtctttttattctgatggtttatacttgcaggggattcctgccgtttcatgccacaaaggaaataacaagcggaatgacctcaaataccctgtcatgtattgtcatggatagtcagtttttgtcatggcggaaggggcggtgaaaagaaaaaaggctttcccgaagggagtcgtggagccagcctcccttggggaaaacaggatacggcggacatccggtaccgtgaaaaaagaaaaatccccgccggcacacttcaaggccgacggggatcgcaataataaaggagcgggcttctcaacccgtgatgtaaccgtactttttcaggtcgtccatgaaatgctctggcgtgtcggtcctcaccgtcaccccgtgcagttccctgtaccgcccggagaaatttaccatgtactcctcgtcggtgcactcgctgtcaaaccagctgccctcacgcaggatgcgtacaaactcggaagggtcggaggcgacaatcctgccgccatccgccaaaatatacatatgcttgttcatgccgatagttttttcgttcttaatttataatatagtttctgttcactgtcaaggaaggggatgtcctgaagtgcggtggctgcgggtacctgtccccttgtggcaaaggtaaccaatttgtggagaaacagcacccagttacgtatttttgtgaagttggtcgttcccgaatgctggcggaactcgaccgtcttatgccgtgagtaggcctcgaggttcaccttatggtaacggtcgccgatccttcctttcagctcgtccaccgtccgggcggaacgtatcatcccgtcagagacatggcccaatccacggcaataatagttgtccctgcgggatgccggcatgaacctgtcgatgaccggttccaggtgcttgtagctcaaggccaggttacgccaggtttccatgctgaaaccggcggcatcgatatgtacgtgaagcccgcagctctcgttcaccttcacgtcacacaggtcgagcacccagcagatcttctccagttcccgcaggccggcttcgccgaccaggatcggactgaccagctcgaaggtgttgttaccgcttatactgctgtccgtcacgagtttccaatgcggacgggtggtatggttgtagctttccaccgtaacctcgataccggcctccctgagctcgcgtgcaagccgttcacgggagcagttgtaagcctcgatctcaataccaaacttgcggttgaaagtgtaatccagtgcggctgtcgccggatggatattcagaccctcctcacgttccctcatccggcgcagggcgttcactacaaaaccgtaattgccgttggtcaccatcctcgcgatttccgcacggggaacccccagaagaaatagctgctggatcttgcttgtcttcgttgtctcttgtgctaaaatgcttctaatttgctcgttcataacttgttaactcctttattattacactactaaggtaatgcttttataggagaagtcgtaattataagagccttattatcatgctattagcttactttatcttaggctaaaagtccttatttgaggtttctgaatcttatcagccgcaagttcaggatgacaaaaggcgacaatatatcgtaacagccggataggagtatatcatgatatgataagccgcatagggcgtgatatcggaataggaatagatggggctatgctgatagcggtataacgggttaaccgaatagtgatatatcatgatatgacgagtcgcataggacatgatatcggaatatggatagaccgggttatgctgatagcggtataacgggttagccggattgtaatatatcatgatatggcgagccacataggacgtgatattgggataggcgaagctacgccgatagtgatatagcgaattaaagactatggggaagacatttcccaaaaataggtgaattatactgccaatcaatgatatttcacctccggttctttcttatatggctatatggttatagtactatcgcaaataaccatatagccgatatgaagtatttgtcttcaaaagaccgaaaatacggaaaaactggcaaaaaacatatgtgttttgcccctgacaaaaggctttatagcattatcaggatatagcgtgatattcaaaacgtggtccgctcctgcggacagcaagttgtgttttcgttaaacgaaaaccggacggtttaacggcaattaagccgctaaaccgtccgcttcctaagctccgaagtcgcctgatttatcattactggttattcaaataaatatattagtttgttcttttactgtcaggatcgtgattttacgttcctgaaggggaaccgttaatttccattaactgccttgcagtctcccggttgtaccgcatgactgtaaaatcatggatgcggctatcgccatgtccgtacaatgaaatgttaaatatcccaattatcaaaattcttttttcttcttttccattatcatacgaaaaatagtaaactaaaaaacaaggaataatgatggacaggaaaaaggaaacattactttctccattgttggatcggacactggaagcattgaaaggacaacgtagcgtgcggacactggagaattaccgcagcagtataaataaggtaaaggaatttgccggtgatggttgggaaagcctgacaatggaaaacatcacaaaatgctggacggacaagtatgccgcatggttggaaaagcgtcatgccgacaagcctcagacggcggacttctatctgcgtacgttccgggcggtgtacggtcatgcgttggctctttcttccgagggcacggatgggaagcctttcggcggacatcgtaccggcggatactttcctgctaaacgtgcgctccgaaaagaggaggtgcaacgtctgctctcgcccgacttaaggcagacattaccggagaaccagcgcgaggcattggatgtattgctgttcatcctctatgcacgggggatggtgttcaaggatgtgtacggactgacgtggcggatggtaacggacgggcatatccgttatagacgcagcaagacggacgtgtctattgacgtggagatagtgccggaactggaagaaatcatggaacgttaccacctggaagattcaccctttgtcttccctttcctgcacgaggcaaggaaaggatgttccggaaaggagctgccggaggaatccgctttgcggcgaatcaatcgtacagcccgtatgatagggcggaaagtgggactctccgtacctcttacaacctacgtgctgcgccacacgtgggcaacattaatgttggaagacagccagcctgtggaactgatcagccagtgcatggggcacacctcgatacgtaccacgcagatctacctttcccgtatcagtagccggaaggttgatactgctgtggacggcatgtacgaccgtatgctacggaagcccaaacataaaagaaaggaaagggacatcccgtccggttgccatcgaaaatccgaatccggctcaccgcaaccgatggaaaacgggaacacacatccccatgtttcccaaactcccgaaaacgaaaaatgtccctttcttagcaagaaagagacattcgtttcgtgtcacgtgaacaccgtaatatttttcgctgcaaaggtatatatttcatacatttgcagcaaattttcttccgcttttttctctgtttcacctgatatttcttcctgcctttccgccctctattctttccatgcgatgtgaaacacattttcaaccgcctgtatcacagaattatataagtttatttcccgtaatgtctctttcttgctaagaaagggacgctcattaaagtgccaccaagatgtatggaaaagcgaaaaaatagacaggaaagcaaatcctgtttctttttcccatccaaatacagtgaaccgttgtatttgccgtactattcgcaaatgtacggcaaataggcaagaaaacataaggagacgataaaatgaaacaaatgacgaaggaaaggggcgggtcatgctgacgaaccccacacgatacgggctgatcgcctgccgctatctcgcatggggatggcactacggtgtatggctcaacgcaccggagatagcggagcgttaccgcatcaacgtgcgtgccctctcaccggcgttgctgcgactggtacaggcgggtatcctgcactcacgtgtcggagggccgaagccgggatatatgctctcacgcgaccctgccgaaataccgatgctggaagtggtacgcgcactggaaggaaccttccgcatggactgctgccgcacggtactcccgaacgtccagtgccagtgcgaagcggataactgtcgggtatgcggagtgttccgggacatactggacgagcttcggtcgcggctgtcgggtgtttcgctcgaagaccatgccgcaactgaagaatttctaccaacttactggggggggtaaaatactgcaaaccaataagatagaatacttggtttaaaacgggcgataacgcatgagaaacgagaactaaaatttaaaaagaaacgatatgaaaaaaagattcattccgtccctgttgctggcggccttgcttgccgggaacgcccaagcggaaatcgtgtcggacagcctccgcaccacgatctactaccgcacggcaagcgcacggctggagcttccctacatggacaacgaccggcaccttgcggcactgggcgacagcatccgttctcttgggggcgacccggcggtggtgctcaggcgcatccttatccaagcgtccgcctctcccgatggcaacacgaagtacaacaaggaactcgcccggaaatgcggtgaggatttacgggattatttaaaagacaacctttcgctgcccgacagcatctttgcactccaaccgcagggagagggctggagcgaactggctgaaaagctcggacgtaccgatgccccttggcgtgacaaggcaatcgccatcatccgtgacactcccgaatgggtggtacgcgagggcaaggtggtggacggacgtaaacgacagctcatgaaccttgccggcggtcgcgcatggcaatatatgaaagagaacctcttcgatagcttacgcagcggtgcactcgtggtgtgcgagatggaacgcatcgagcgcgtgaagcccaaacccgaatcggcacaggccgaattgaagccggcacccgaacaggcagtcgacaatgtgatgaaccccgatgacacggtggacaccgccgggaaggagcttgaaacgaccgccacgctttataacaaggaggacgagacgattccgcaggataacacgaacgaagaaatggaaaagagacctttttatatggcggtcaaaacgaacctgctctatgatgcagcccttgttccgaacgtgggactggaggtctatctcggtggtggctggagcgtcggcggcgactggatgtacgcatggtggagcaaggattcaaagcaccgctattggcgcatctacggcggtgagttggaagtgcgcaagtacttcggaagtaaggcggccgagaagcctttgcaaggacatcatgtgggcgtgtacgcgcaggggctgacctacgacttcgaaacgggcggcaagggctacctgagcgattttaactacggtttcggattggaatacggctattcgctgcccgttgccaagaggcttaatatcgacttcggtatcggtgtcggttacagcggtggcaagtacaaagtatatgagccggaggacggttgctatgtatacaaggaaacgaagagacgccgctggttcggcccgacgaaggcggaaatctcgctcgtctggttgttgggtcgcggcaacgagaacagcaagaaaggaggtacgaaatgatacatatacggatatacaaggaactgcacaaggcaatcgcaggatgtctggcggtaatgctgttgcccctgctcacggcctgtgagcacaaggatctgtgttacgaccatccgcactcggcgagcgtggaggtggtgttcgactggacggaagctcccgacgcctaccctgccacgatgagcctttacctctatccggaggacggttccgagccgatgcgttacgagttcaccaagcgtgagggcggtaccatcgtcgttccggagggtatgtacgatgccctttgcgtaaacagcgacaaggagacgcaccgcatagttgacaaggaacgtatggagacatttcaagtgacaacggggaacacccgttcactgcgtgggacactggccacgaggtcggaaacggcaccgaaggcacgcggcgcggaagaggagcgcagcgtgatggaacccgaggccctctggagcgaccatgccgagcggttggacatcggtcctgcgagcggcgtgaagcggatcgtcctgaccccgaagccacgggtgaacacctgctcggtggaggtcaggaacgtggagaacctgcgtcacgtaagtgcccttagcgcatcgctgacgggcatggctggcggctggctggcaggaattgacgagctgacaaccgagaaggtgaccatcccgttcgaggtacgcgccaacgaggacaagacgcagctgtcgggcaacctgaccttcttcggccactgcccgaaggaagccggagtgcacaagctgatgatttacgcgctgatgtcggacggcagcacctattatttcgaggcggacgtgaccgaccagctgcacgatgcggcgcaggacccgacacacatcgtcatcgtgatagacaagctgccgctcccgaagcccatcaccggcggcggaggtctgcagccttccgtgaaggactgggaggaagtgcacatcagcctgccgatgagctaagcagagaacaagtggaacagaaaagtaaaaatacaagtatatgaacaaatcgatttatatatgtgcggctgccgcgattatgctggcttcatgctccaacgacgaggtcgtggaacaggcgcaggagaatgccatcagcttccgcagcatgatgggtgcgaatacccgtggcgtggtggctgacgttagtaatttgaataccctctgcgtgacggcctatcaaggaacaagcctactctttgacaatgtcatattccaaaaggacggtacgggcttcttcaactctgcaaagccttattattggccggaaaccggcgaattgactttcacggtactttcaggcaactggagcggtacccgtgatttcaccagctctacggaacaatggatgagaaatgtcaccatcaacgatgatattgccaagcaggaagacatgacctatgtatccaatgtgacaggcacgaaagccgacaacggaaaagtgggcgtaccgctggaaatgaagcatgcgcttgtacagatccagctcaatgcgaagaacgaaaatagcaattatgtgtacaaggtgaagggcatccgaatcaaccgagttgcaaccaatgccgacttcgacatgaagaaagagcaatggggaacagcaaaaggagaggcgactttcgaaatcacttacgacactcccatagaattgacttccaaagcccaatctattatgggaacggctggtaatgccatgctgattccattctatttggatgcttgggatggaggtggaaagttgaatgcaccagatctttcagacaatgtgcaagtaccaggctataccgctaatcccggtgggttcttctctgtcttggtaaacatccggatgaaagccggagcatcggtctacccggacaaggcaggaggctatgcgtgggttgccataccggtgtactatgtgtggaatgcgcaacaaggcaagaagttcacctatacgctcgacttcagcaacggtgccggacgggttgatcctgtagacccgggcacagactgggatgcaagcaaagaccctgccaagatgcaccccgtcttaggtggcctgatacgcttcggtgtgacggtcagcgagtggggcactgatgacaagaacgtggacctgaaagattcggaaaagttcgatgtcacggtggacggctggacggacgatacgaaggacgctcccctgaaatgaatctgaaaagttatacaaaaggttatcaatcaattattttttttaattttaatttttcaattatgaacaaagcaatttatttgtgcgcagcggccgctttggcgctggcatcatgttccaacgacgagactgtggaaatggcacagcagaaaggcatcagtttccgtgccgtgaccggactgaacacacgtgcttccgaagtgacaacgacaaacctgagtgaaattctggtaacagccttttgggatgcgaacaacaacaagtacgacggttttactaatggtgaggttctttataaaaaggacggcaatggcgattttaattccgccattcctgtatactggccaggaaaagaccaggaaaatgagaagttgagcttcaccgctttctccaataactggacaggaaataaaactatcacggacaagaataccatcagcgtgggtagtgtcgagattaacacagatgtggaccagcaagcggatatggtatacgttacaggcgtgaccggaaccaagactgccaataaaacgagcggtgtcgcattgacattgaaacacgccctttcccagatccaaatctctgcaaagagcgacaatacggtctacacataccaagtgaaaggtatccgtatttcaaacgttgacggagaggccaacttcgatgtcgttgccgacaagtggagcaacaacaatgcaaacgaccaagtttacaatgtgacttacgacaatgcgataaccttgagtggtaccgctcaaacaatcatgaaagccgaaggcaacaacctcatgctgcttccgcaggaagctaccacggcttgggatgttgaaaacgacaagcaaaatgccaacaagggtacatacatctccgtactgttgagaatcactaagacggctgataacagtaacgttttccctgctgaaggtgctgacacttacggttgggctgccgttcccgcttcattcacttgggaaaagggcaacaagtatgtctatactttgaacttcaccaacggtgcaggacgtgttgaccctgtaactccgggaccggatgttaagccgcaaccggacggaaaagacccggacaagggagacaagatcttgggtgacccgatcaagttcaccgttactgttactccttggaatcccaacggtaacagtatcaatatgtaatccgatatccatttaatcaaaaatcaataaccaaatcgcgcttccgcccggtggctgtccgcacactcagccaaggcaggaagtgcgcccttaggccggacggggttgaatgtccctttccggtcacacgaaaagacaagctaaaaaagaagaactatggcaaataaagcgattcatgtattggcggcagcggccttgatccttgcctcgtgctccaacgacgacacggtacaggtagcttcggggaaaggcatccgtttccgcacgacggtgggcatgaacacccgcgccctttctgccgaccttgccgggctgaaagctgccggcttcagcgtgtcggcgttcgccacggccggtaacgaggagaagtacgggttccggaacctgctgttcacgcacgaggacggcacggagaacgactggacgtccgaccccgtgaaatattggccggacgacggcagcgagctacgcttcgtggcatcctgtcccgaagccacggcttggggcggcacctacgagggcgaaaatcccggtgaactgaaagtgaccggcttcagtccggcagcggacatcaccggacaaaaagacctgctggcaggttatgcctcgggcgataggaacaatgccgccaagacggagatagagttgcgccatgtgctcacgcaggtagaggtacgtgccaagaacaccaatgcgacctaccgctacgacgtgaaggcggtacgcatcggttccgtccattccacgggcgactacacgttcccttcggaaacaaatgccaacggcagctggacactgaaggacggaagctacgcttcctataccacgaagaacttaaaagagcctgtacgccttacggcggatgccacatcactcatgggcgatggcggcacggcgatgctccttccgcaacaacttacggcatgggacacgaaagacgacaaggaaaacaagaagaacggttcctatatcgccctgctcctgaagatcaccaccgcagcgggcagacagatctatccctccaccgagggtgaatacggctgggcggcagtacccatcggagaccatgcggagagcaagaagaacctctggcagccgggcaacaagttcgtctacacacttgacttgagtaacggcgcaggggtaacgccccccgacggccccgatcccagcgaaccgatactgggacaacctatccacttcacggtgacggtgaacggctgggcggttcgccatcaggacgtgaacctgtaagatagaaaatgaattacgaataaaaaacgaatgacagatatgaactacaagaacaaactgatgggcttgtcgctcatcctattggcgatgttctctgcctgtacggacgaggtggagaagggaggccgtgactcggacacgggcgaccaccgcatcacctttgccgtgggtacggcagcccctgatgcccggacacgggcggacggcagccgctcgggtgccaccgaatcatacgaaaccagctccgtggagatgcagggcaagctggacggaaaaaccgtctacctcaccgccgaagtctccgacggcttcccgggcgacggccaacccttgacacgcggcacgcaggtgacgggggtcgcacaggtggatgaatttagtgtgtcggctgctattttagatgccaacgtttttgaacccgagacgttggatgtgatgtacaacgtgaaggtgacgaaagacaacgccgcttccacatggagtaccggaacgccgtattactggcctaccggcaagaaactgacttttttcgcttggtatccttacaactcgaagaacctgaccttcccgaaagacaacaatgtcaaggatacgaagctgttctacgagatacccgaacaggtagccgaccaagaggactttatgatggccaacagctatgaagtgagcgagacatcgagcgtgccgatttttttcaggcacatgcttacggcggtgaagttcaagacgagcaacaacatccctgcctgcaccgtcaagtccatctccctgaaaggagtgaaatacaaaggctatcataactggcaagcacatggcagcggtatattaccttgggatccggatgctgacaccagagacttcaccttggactttcccaatggaaaggaggtagccgagaataccgagaccgaactcacgggaaagggcgagactttcttcatgatgccgcagacatttggagatgacagcgaagcccgtttggaagtgacgttggagatgaatggcgtggagcagaccatcggtgccaaactgaaggatcttgcctatgcttatggttcgtcagtttggaatctgacaacaacggttacatataatatctcgctcgaccagaatgtcgagttggaattgaacaaggatgtcttcgtggcttcgggtgccgacgccgtgatttatgtgaagagcaactgtgactgggagtgtacactgagcgacccgaacggcatcaccggcagcgccgcaccggccttgtgcaagccgacgctgaaaggtagcaccagcggagtgcagtcggacagtttcgataatgaaaacgcgaaactcacccttgaaaccatccaaccgaccgacactgagacgcgcaagggcaaggtgaagctcacgtttacgttcccttccaaaccgggaaagacggtagagaaagaggtgacgctgacttccagtctgatggtggaatatccgacaggaagtgacatctggtacaaactgtcccaagggtctatgagttgccacgacttgatgaccaccgatacgcccaccttgcccgataatgccgactttgccacggccatagccaaggtggtaggtgccgatgtgacatatagccgcgaactggtagcgacaagaactggaggaacttcttatgatggcgatccggccgtcttcacttacttcggtatccgcagagccaaagccgacggttcgaccatattggtgaacctttccagaatcaccttggagaactatggcggttcaactttcgatgaaaagaacttcatgacttggggtggaacttactatccagtaggtagcacatggacggtgaccaaagacaactataatgtgaagactcacgtagacgacatgggtacggatttgtctgtttggcaaagcactgccatgggtaactggggatatgaccaagcgtatgactatagtagttctactttccgctatcccggttactacaccatcaagaataacaagttcggctactactccattgaaaaggtctcaaattgagaaacaggcaaggcaagatcaataacagtttgaacaataaaaaagacaagatatgaactacaggaataaactaatgaacctttctctcatcgcgctggcagtattctccgcctgttcggacgaggtggagaacggtactcacccgggaaagggagaccagcgtttgagcttcgccgtaagcatgggaggcacgaacgcatggaaaccgacagccggcacccgtgcggcttccggtttaggggagagcacgtacgagctgaaacccattgagatggaaggcaaggtgaacgggaagaccgtctaccttaccgcagaagtgacggacggatttcccggcgacaaccgtccgatgacgcgcggcacgcaaatctccgagaccaacaagacggatatggagacctttgccttatcggcctataccgatgccaccggcacgcccgacttcatgtacaacgagacggtcaccttgaataaggacgaaggccgttggtatcccacggggacatactattggcccggcaagaagcagttgagcttctacgcatggttccccagtgcggcggacggcatgacgctcactggcaataccgatgttggcgcacctgtgataacctataccgtgcccgatgacgtgaagaagcaacaggacgtgatgagtgctgcagccatcggaaaggataatccgacggcagacggtttcgccaccaccgacctgacgttcaaccacgccctctcggcagtgaagttcgtggcaggggatgacctacccaactgcgtggtgaagtccatcaagctggatggcgtgcgctacaaaggtacttacacgttaggaacggacgcatggacattgactgatgacacgcaagcctttaccctgcgtttaaacaaagtggtggcaggaaacggtggagccattacggaggatggcaaaggcgagaccctcttcatgatgccgcagacattgtccgacgacgcgaagatcgaggtggtgctgaatgacggaactgccgactttacggtgggcgcatccattggaggcacgaaatgggaaatgggcaagacctatacctaccacatctcgaacaattttgtgtcgctggttaccaccaacgacaagttcatcgcctacacggacgaaaccctgacggatcaggtggctttcttcttgagtgcatccgcaactactgccgggactacgggtacgattatagccccgactggattaaccgttacacctaccacttttgcaagcggtgcgtctaacatccctgtgaaggtcacttggccaaaagacttggggaattatataagtatagagattcagttcgcaggcaagaaaaaacaaatcagattgtcccgtcagacacccactgaaggggatgcccattggctctattccttgcccgagacgaccagccagcacttggaaaatgacatcatcggcttgcagaacgcatcggaatcggactggatagccatgacctcgtctcctacgtacacgaaggacaattattcgcaggtcatttatgacaactcctcaaagggcgacatttacctgcagacgttgagcatcccgtcggcgaaccgcttcgcctcgttgcttgccaccaaagaggactttgaccaaaatgtgatgtactgcgtggagcagaaagcctttaccgccgatttcggcttcaagggctgcgaacgaaatatttcccgcgaatcggagaaatggaacatcgtgctgaacggcggacatttcaaggaggatgtaacaaacctgaaagccagagtggtaatctcctccgatgtatctgatgagctgatcaacgatcagggacgtgatcttacttatggcgaaccggtgtctattgtcgtaaacaaaactacatctatggctgtgtccgccactccttacgtgaagaagcgttgggacaaccagcaaaacaatacggccaataacggcacacgcaaggtaaacgtgcaggtgaagaacgacggcatggacgagtggtacgattgcggacctgacggattgatgagtgataggttcacgtggggaaataattttgcaataggatataaccaataccacggaaaaggtaataattggaataatggtgcacttccaatagtccgggattattatgaagtgcatcagaaacacccgatgtttggcttgcacagatggtctataatgagggacaacagtgatgcaaatataatggggaacgccctatatatgatattctgcagtgccagacagtggaacggatggaagaatggaagcatctaccgcaatagtacgtctgggggatggtcatacattgcatgcaatcaggcaaacagcattactgatcctgaaaatcccaattacaatgatgtctataatggcggccgattcatcaccattggcgtaaatggtcgtaactggagatggtcatcttggcaaaactatccgggacctcttacagtatggattccggtagtatacactgactcccattgcggattgaacgcacgccctacagacggcactcccattcccggaacatcggttaacgaatagtggcaaatcgctttaataaccaacaagattatatatacactttaattacatcaagactctccccagcacagcgggagggattatgtataataaccctaacaacttgccgcccttgtgaaagaccggcaagtctccctttatttcaataaaactaaatacatatatggaaacaacgaagctattggagacagaaaaagaaaacaggaactccgtccacctctattggaacggaacggacgagacttggaacgcctacggcaagtcagcagagaacgccatgcgtatcaaccccgaactccgcacgctgacggacaaggcggagctggacggtacgcaggtgacgcacctgaaagtgaccaccgaacagttcgagcggtacggccttgccgaccactgcgtggcggtggacgacgagcgtctggaactgaagatacccgtgcatggctgaacggacggacatgaaggacttcgctgcaaggcttgaggaagaggcggaaaagaaggtagagaagatagaggccggagacctgaacatgatcaagaattcattcgaagcctcgttagtgcttgcggacgctttcctgcaactgaaagccttcatagccgggtacacgttccgtgacgaagcggaggaaatcgagttcttcaagacagtcaagccccgaatctgccaccggctcatctactaccgcaagatatacaacatcgagatgaaccgtcccgtaggcaacgaatcacagcgaagctacctgatagacgagatacggggcatcaaccgttacaacgagaaacgttcggacttcgtacgttactaccgctccgggctgacccacttggacgcactctattacctgcgtggcaaccttgacacggctctctacttggagtcgttccatcacgaacgagatccgtccttctcgaccaactgtgacttcatggcggcacggcttctcgccaacgagcggctgatccgctacctgacgaaggaattagaggcgttcgagttgcggcaagccgaagaatcgttgccgaaggtgcgcctgacgtggaaagcgacgaagacggagctgaccgaactgctatttgcattggacagtcgcaaggcattcggggatgtcccgttgacaaggctgtcggagtatgtgcagagggcattcaacatcgagttggacaagaacctgtcccggacattcggcgacctgcgcatccgcaaccggcagacgcctttccttgacagcctgaaggccgcactgctcaggcggatgaaccgcccgatgaacagccgtcccggagggcggaacaaaaaacgctttgagaaggataagaattgaataataacaaacagaaacctaaatagaaaaggacatgaaacaggtatttgtcaaacctctgttgctgctgctcgtgatactggcagcggcatcctgcgacaaggacgagaaggaaatcggctacgacgcgctgccccaaaaggcgcggcagttcattgcgcagtatttccccggtgtggaatgcacccgtgcggtgcgtgacaaggacggcggcacgaccgaatacgaggcatggctctcggacggagcggaactggagttcgacggacagggcgaatggacgagcgtggactgcaagttctccgcgcttccggacggcatcctgccggaatccatcgcgacggacatcgccgcccgttaccccgatgccgtaccttacaaggtggagaaacaaccgggcggttacgagatagacatccccggctgggaactgtactacaactatcaaggcacgttcatccgtgccgaaagggactggtaaaactgcatgaaacaccaataactaaagagctatgatcatctatgacagcaaaatcgcccgtctgctgcaaggccggctgaacccttacgattacgtgaccctcccgatagtcaccctgaccgcctttccctacggggagaaaggcatctgggaggagatggagatgcgcatccaccgccgacagtacacggaatgcttccttgcgtcactgctgccgtccctgcttctgggctggcaagtgtgctggggtcttgccgccctgccgctgttcgcatattacatcctctattgggcggaacgtcaggctgtcggccattcagcgtttgactacgaggcagaaaaagaaagcgaggaagtaagctactttgtagtgagaaaacgctttgcatggagcaaatggtattggaaaaagaagctgccggccatcgaccggagctggttctgctaaaggaacagggctggctcctatacagctactacaagcgtgggctgctgtctgtttaagttgtgttcgggcatcctggggccttctttatgattaaacgagatgcagccaacgcttcctttcatcacattcctctattgggcggaaaaggaaagcgtggagataaaaaaggaaaaagtgcaattcagacatatatacgaagagttacgatgaagaaaacggaatgcgtccttgtgaaaggtcgccagatgtccgccgaagggtagcaatgcccgtaggacacagttttttgatttttaggaaagttcaatccccaaaagggattggatttattaagtgggaaaccacttttttacatgagaaaacaagacccgcacttgtgaaagcccggagcttgtactttagcatggcagcctgccagctttaccccggcaggcttgtcatagagatatttttcaacaaaagttagttcacttcgcatcagcggatgcggtacaagtgaaagaattcaaaatgtctggaagcttccacctgttacagtccgaagcttccgtttttttatatggacagaataaattcaaaaacaagaacgatatggcaacattaaaattgaacaaattcatacttttgccgtgtagggcggcttccgccctcgtgcgctgcggctttgcggtaactgcgggaatcatgatgaaaacgttttcccccgatacgggccgcatattttacgaaaatgcagtgagtgactaccttatacgcaggttcgcggaaatcatgaggtggtatgaggactgcccctgcccgacaggattcctcacggcaggctcgccggtatgggtgttccttcccgaagagggaaaggaaggtgacgaacttctaaggtcggtacgcaaggagatagacaaccgccccatacgtgtgattacccgtgaaaattaccgcagatgcataagccttcccggccagctcatcagccggctcgaccgcgtggatgacgaccttctctccgagtacttgtgtcacaccctgctttccaagcaggacggcacgtatgtggattcgcgcagatgggaaagctccaagaaaggtgacccggtgcacggcttcatatccgacatgctggcggcgtgcctctccgccagcatgcccatcgtggacggtgacctgcccggcatcctcacgcggatggcaagacaccatatcccgagtgtcagggcgaagctgagagaacaggacaggatgatcctgcaagcctgtccctcgctgaatgaatatcagcatgcaatgaagtagaaaatgcgtaccttataaatgcagacgaaatataaaaacaagctgcgaacgttattcttcttaacttaaaatgttggaacgccaatatcaaatattttatgcttttgctggttattttatctgtgtaatttgtggatattatatagaagtatgtatttataaataaaaatcatgaacaatggtataatatggttgaagttaaaaatatcgttcggttatgccatcttggttctgttgtccgcattcattgtctatcagttccgtcaggaacaaatgcaaagacacatgctacgtaagaaggagaaagagctggtggcgatacaccgtctggctgaaagaatctacatcgacctgctggacctttccacccatgccgagattgccgtcacatgggatgatgacgacctcggggaatacagccgcaaacgccacggggtctgcgacagcctgcaacttctgaaagaatatgtccataccccgttacaaaaaagccatatcgactcgttgtgccttcttctttggaacaaggaacttcttttatccaaggcggtacataccttcaaggaactgcaggacataggtgacattgtacaagaaagcattcctgccattgtcttgacagcccggaaacaggctgcacggcaaaaggaaaatacggcttctccggaagccggtgcgggagatgtacccaaaaagaaaaggagtttccgggatatcttccgtagaaaagaaaacaaatccgcttacctgcaacagagggaagaggctgaacgtaaacggcaatccctgttcgttccctcttcaaccgggacgacaacacgcatgctccgctccctgaatgaaagggtcacccgggaacaggctgaaaggcgggccaggctgctggcacagatggacagcctgtatgccggcagtatggagttgaacgggaggatgaacaatatgatctccgaatttgagcggaaaaacaacgaacgttttaccgcacgctacagggcctttgtccttgaacgggacaattcctaccatatggtggccggccttgccctgtccgtctcccttctggcgatcatgctgtataccgtcatacaccgggacctgaaccgccgtctccaatacgagagggagcttgaacagtccgacaggcggaacagggaactgctccgctcacgcaaggagctgatggcctcggttgctcacgacctgcgcgccccgctggcggccgtcaaaggctgcgcggaactgttaccctcggaaagcgacgtcagccgcaggagtggctatctggacaacatcctgcactcggccgattacatgctcggcctggtaaacacgctgatggaataccaccggatggatgaaggcgaagttcgctccaatgacacgctctttagcctaaaagccctgttcgaggaaatagcggacagtcatcgacttatcgccagacagaaggacctggcgttcaccgtatctttctccggcctggatgccgtcgtctgctgtgacagctcgcatatccggcagatagccggcaacctgctgtccaatgccctgaagttcacaccccacggggaggtgcgccttgaggcggaatacttgtatggggaacttagcatctctgtccgggataccggcgtgggaataagcgctgaggagaaagaacggatattcggggcgttcgaaaggctggacaacgcgcgtaacattcccgggttcggcctggggctggcgatcacggtccggctcgtatctgaaatgcggggccgcgtggaggtaaagagcgcctccggtgaaggcagccgcttctccgtattccttcccctgccaccggccggacagtcctcccgtctggaagagaaggtgtttccgacctgcgaactgcccggcgtcatccgtgtgttggtcatggatgatgaccgcatccaacttaggatcacccgggagatgctctcccgcagccggattcactgtgactgctgcacggatgtccgggaactgatggactgcctgaaaagtcaggagtacgaccttctgctgaccgacatacagatgcccggtgcggacggcttctcggtccttgaactgctgaggggctcaaacatcccccgggcaagggagattccggccatagccgtcacggcacattccgacagggaagaggaatacctcttcgcaggtttcgccggatgtatccataagcctttctccgcggaagggctggtgaccgccatcatgcgggtcataaaagggaccgggaaagagtggaggccggacttctccctcctgcttgccggagaggacaaccggcaggaaatgctggggctgtttgtcagtgaaagccgcaaggacatcgaaaggctgtcggccgccgtgaaagaaaaggacagccgggaaatcatttccatcctccacaagagcctgccactgtgggagacggtgcgtctgaactatccggtagcggacctgtgggtgctggtcaaatccgacgcgggccaatgggaggaagaggaatatgtgaaaatagaaaaaataatcggtgccgtcagggaactgatatcctatgcggaactgatgcagaaagagggaaaggaatgaaaacgatactgattttggaagatgacgtgattttcagccgcagcatcggcaactggctgaagaagaaagggatggcgaccgaacatgccgcgacgctgtcggctgcccgcaaggccctttccgcaagggagttcgaccttgtccttgcagacctccgcctgccggacgggaacagcacctccctgctggaatggatgaacgagaggttctacgccaccccgttccttatcatgaccaactacggtcaggtggagaacgcggtggaagccatgcagctgggggcggtcaattacctgtgcaagcctgtccagccggacaggctgctggaagccatcgggaagatattcagccgtccccgacatgacgggaacgaattctatcgcggggagagtgccaaagcgcgggaaatgtaccagctagtggggctggtggcacgttccgacatttccgtgctcattcggggagcctccggtacggggaaggagcatatcgcccgcgagctgcatgaacaaagccaccgtagggacaagccctttgtcgcggtggactgcgggaccatcacgggtgaccttgccaaatccgaatttttcggacaccgcaaggggacgttcaccggtgcctacggtgacaggtacgggctgtttcaagtggctgacgggggcacgctgttccttgacgagatcggcaacctttcccccgagacacagatgctcctgctacgtgccctgcaggaaagacgctacaagcccgtcggctccacccaggaatacacctttgacgtccgtctggtggccgccacgaacgagaacctggagagggcgatatccgaaggacgtttccgggaggacctgttccaccgcctgaacgagttcaccatcaatgtcccccctctctcggaatgcggggaggacatccttccgctggcggagttcttcgtgaagcatttttcagaaaagcaccgtaagcccgtacgcgggttcaacagcctggccgcggcctcattgcagaaatatccctggcccggtaacatacgcgagctgagaaactgcatccaacgtgccgtcctgctctctgccgacggatggatctcaccggaggaactgaatctggacctcgccgtcggacgggaggaaaccgcccccattccggaggaaaaggaaaaacagctgcttctcaggacccttgaagaggcggagggcaaccgtgcccgtgcagccaggatactcggcatcagccggacttccctgtacgagaaactgagaaaatatcggattatatgagcgggccgttgtacaatacgggccagctccgtgagtctccttccggaaccacagcgaaatgagagtgtcatacaagcggccggacatggtttacataaaatgtacatccgccttacagttattgtaaagcggtgtacatttctttttttgagcctgttttcaactgatatttttatcatgctgaatatctgactattaacaagaaaatgcaataggcatccaccggatggcatcatattcgcctttaatattctgtcgtaaggcatgaattgttaaactaaagtttgagcatatgaaaacatcaacaacacaccgcctgctgaaccatctccaagaagccgtcctggaaggaaaaaatgctatggaaaacgtattgtcatccgcctacgatgaattttcagaccatctggcctccctggcggaaagcgggcttcccatccccaagaggctgcgccgcctacgccacatggagacggaactggacgcctatatgaatatggccggaagcagggctgacagccggacacatatctatctgatgaaggcatccggccttgtcaggacggagatagaactgttgcatttcgcgcttcggtatcccgaatgccgcgataccgttcccgataccgacaagggacggacaggcctgttctcccttcgttggaaaggttccctggtgaacctgatggaactgatcgcctcactgcactacctgggagtgataacagacggtaacggcaaccgccagtcattcgcctccctggtggcggcattcgaggagttcctgcatatccgaatccccaagccctacgatttgcgtgcggaccttgccagacgtaagaaaaccctctcggtactactcccaaaactccgggaagcctttgaaaagaacatcataaactgcgggatcgggaacggatgacagagcggaaaatccccctgtcatgaatagtcatcccctgtcacgaatagtcaccttccgaaattaggctggtattcgaattatcatttactttgcccccggtaaaaacatcaataatatggctaagatcaaacaggcgtacaagaaagagagaacggccgcctcccggacatgaagaggcggccgcagtccgaaggaatcctccgagctccattccttttactacggattccgtctgaacgagttccagaacatcgagttcgagcggctctatgagaattccggtgccgtaaccaagtcgcagttcatcctgtcggccattttcgacaagccgatgaaagtggtgaaaatcgacaaggcggccacggactactgcatcaagctcaccaacctgcagagcgagtaccgccgcatcggggtgaactacaaccaggttgtcaaggcggtccacagtggggaactgaccgaaaagaaagccctcgccctgctttacaagctggaacagctgaccgtggagctcgtatcgctgaacaaggaaatcatccgtcttaccaaagagttcgaacaatggttgcaaagataacatccggtgccgccatctacggggcgctgtattacaatcaggaaaaagtggagaaagggaaagcgcggacactggcatgaaaccgcgtgatggagacaccggatggaaaggtcggcatcgccgaatgcatgcgcagcttcgaaccttaccttgccgtgaaccgccggacggaaaagccggtgatccatctctcgctcaatccccatcccgatgacgtgctctccgacgaacagctggaagccatcgggcgggaatacatggacaggctcggatatggcgaccagccttacgttatcttccgccatgacgacaacgcgcgtcctcacatccacatcgtctccctgcgtattgatgaacagggaagaaaactgagggattacaaggaatgggaacgctcaacggacatctgccgggagctggaaaggaaatacggcctgctgcagtcacgcggggaggaatacaggatttcccggccgatgaccgcggtggactgcacgaaaggcgaactgaaacaccagattgcgggcgtggtaaaaccggccgtgcagaattaccgcttccagtcgttcaaggagttcagggcgctgctcgggcttttcaacgtgaccgtggaggaagtacacaaggccgtggacgggaaacgttgcgacggtctggtctatgcggcgaccgacggaaagggaaaacgtaccggggtcggaatcaaatccagcgatatcgggaaaagcgtgggataccgtgccctccaaaagaagttctcacaaagcagggcatggatgaaaaagcatcccctgccggaaaagacaagggaaaacatccgcacggcactctgccgggatacccgtgaagggtttctgcacgagctggcaggcaaaggcatcgtgcccgtactctgggagaacggggcgggcgtaatctacggcgtgacctatatagaccataataccaggacggtcttcaagggatcggcactcggcaaggaattctccgcttcggttatcaaccggaaatacggcacgctcccgtccgtctccgacaagccggcttcaggacaggaaccgcccgtgaatacggacacaagggaggcagggcttgcggaaggcctgctggatctcttctccatggaatcctgtccctacccgtctgaggacatcccccggaatgtttatggaaagaagaaaaagaggaaagggcggaaaggcccgcggatcaactaacgaagtattcacatataacaacccatcataccccatatggcacaagaagattccagagggctcggcaagaccatcgacttcatgcgggcggtcagcatcctgcttctcgtgatgaacatctattatttctgctatccgttcttccatgccgccggttgtaccaacggcatggtggacaggatactgctgaacttccaacgtgacacagggctgttcaccggctcccccgtgaccaaatgcttcagcctgatgttccttttcttctcctcgatgggcgccaaagggcggagggtcccggagatgacatgaaggcgtatcggctgttacctggcagccgggctgctcctctattggggaagcgagcttttcctcactgccggctggagtgtcccgctcaccacccttgcgtatgtgtccgcccttaccgccggatacatcagcctgctcaccgcaggcatgtggaccgggcgtcttttaaaggaacacctgatggatgacgtcttcaatgaggagaacgagtccttcatgcaggagacccgcttgatcaccaatgaatactcggtgaacctgccaacacggttctattacaagaagaaatggcacaatgggtggatcaacgtcgtattgccccaaaggggctgcatggtggtcggttcgccgggcagcgggaagagctactgtgtcatcaaccagttcatcaagcagcagatagagaaaggctatgcgctttactgctatgatttcaagttcccggacctgagccttatcgtctataaccatctgctcaagaacaaggacaagtacaaggcgaacgtccagttctacgtgatcaatttcgacgatccgcggcacagccaccgctgcaaccctatcaacccagcattcatgtccgacatcgccgacgcctatgagtcagcctatgtaataatgttaaatttaaataaaacctgggtgtgacctgtaaagtcacgtaattgattgttagacagtgatattaattgcatgatttaacccgctgttccgtcagcggtagcctactataaggtgcatctccagtgatgggttgtgccaagcttataggacaaagtacactttccgaaaggacaagactgaaccgtgagggaatgtcaaggacggttagtatcataccgttgagtggcgaggctggatagcatggttaacgtaagtgaactgactttagccgtcgtaaggtttgaaggagcgcaagatactttagctctcaccaaaaggtaagcagtcggataacccttgcccatgttggggttacacggacacagcactgccggcggacttggcagaacctaaactatccgtttgtcaattacgtggaacagggcaagcctgtatctctctcgtaagaatgcgagtaagcgaaccgcaaggcaagccgaatggggtgcaggtatgagataacggaaaaagcgaatgccaccctgtaatggggtggatacggattgaatcaacatcacgggttgttattggtgacatcatccgacacgaaagtgggcagacttccgtatatggtaactctttacaagataacttttagaactttcaaaaggaggaaagcaaatgaacgaaactaaaacatcgtgtgcgcctgctgatagtaggaatctaacttgggacggcatggactggtccaagtgtgaagcctatgttcgaaagctacaagcgcgtattgtaaaggctcaaaaggaaggcagacataacaaggtgaaagccttgcagtggatgctgacccactctttttacgccaaggcattggcggtaaagagggttacttccaacaaagggaagaaaacgtctggagtagataaacagctttgggattctcccaagcgcaagtacaaagcaatcggtgaactgaaacgtcgtggttacaacccgcagccgcttcgtagggttcacatcaagaaaaagaacggtaaactccgaccgttgggaataccgacaatgaaagacagggcgatgcaggcattatatctcatggcattggaaccgatagccgaaacgacaggcgaccgcttttcttatggtttccgcaagaaacgcaggacaatggacgctatccgtcagattgatacggttctaaaccgccagcattcccccgaatggattttggagggagacattaaaggctgcttcgaccatatcagccacgactggcttcttgatcatatccctatggataagacgatactcagaaaatggctgaaatgtggagctgtattcaatggcaaactattcccgacagaagagggtacaccacaaggaggtatcatatcaccgacacttgcaaatatagcacttgacggacttcaaccactcttggctgaaagattcaaaagattatggcgcaacaataagacattccactacaaggtaaaccttattcgttatgcggatgactttataatcacaggtcgagataaggagctattggaaaacgaagtcaaacctatcgtgatagaatttctcaaagaaagagggctgaccttatccgaagagaaaactaccattacgaacatatacgacggttttgatttcttaggtttcaatgtgaggaagtttggcaaaaggctatacacatccccgtccaaagatgcacagaaacgcttcagggcaaaaatcggtgacatcgttaaaggacataaaatgtgtaagcaggaatcgctgatacgaatgcttaatcctgtaatcacaggttggggcaactattaccgatatggtgcatcaaccgatgcttttcatggttgtgacaatcacatttacattctcacgaagaaatgggctttacgtcgccatccaaagaaacgcaagtcttgggttgcagacaaatattggcatgaaattcgggggcgtaaatggacgtttgcatggaaatatgaaaccaagagcaagaaagtgaactacctgacccttaaaaggttgtcggatatacattataccccgtacaagcaaatcaaaggtgaggcaaaccctttcgacccggaatacgatgattatttctttcagcgaaaggagcaacaaatgctggaatctctcaagggacgtaagtctctcttatatttatggaacaagcagaaccggatttgtccgttatgtggcaaggaaatagattgtacaaaagcatggaacgtcaacgaaatatctgttggtggttcgattgtacggcaacttgtccacaacaactgctacaagcgaaataaacgaaaatgttgaaagtatgagccgatttctaacaacaaatagaaatattgagttgcttgagccgtatgaggggaaactctcatgtacggttcttaggggagaagggggcagcaatgcccttgacttacccgatatacagaaacagggtgacttcttcgtggagagtccgatcgtattgttcgccgccatcatatggtatcttaaaatctacgagaacgggaagtactgtacctttccccatgccatcgagctgctgaacaagccctactcggacatcttcaccatcctgacctcgtacagggagctggagaactacctctcgcctttcatggacgcctggaaaggcggggcgatggagcagctgcagggccagatcgcaagtgccaagatcccgctctcacgcatgatcagcccctcgctctactggattatgagcggggacgacttcacactggacatcaataacccggacgcccccaaggtcttgtgcgtgggcaacaacccggaccggcagaacatctattcggcggccctggggctgtacaacgcccgtatcgtcaagatggtgaaccgtaagggaaagctcaagtgctccatcctggtggacgaggtcccgacgatctatttcaaagggctcgacaccctgatagccacggcccgcagcaacaaggtggccgtctgtctgggcgcgcaggatttcagccagctggtacgcgactacggtgaaaaagaggcgcgcgtcatccagaacaccgtcggcaatgtctttgccgggcaagtgttgggggaaacggccaagaacctttcggaacggttcgggaaggtgctccagcagcgcaagtccgtcaacatgacccgtgaggacacatcgaccagcatcagcacccagctggactcgctgataccggcctcgaaaatatccaacctctcccaaggcatgttcgtgggaagcgtctgcgacagcttccaagagaagatggagcagaaaatcttccactgcgagatcgttgtggacaacgcgagggtggcggcagagacgaaagcctacaaaccgatccccgtgattacggactttaccggcagggacggcaaggaccatatgcgggaagagatagagcgtaactactaccgcatcaaggaggaggtgggcgggatcatccaaaaggagctccgccgcatagggaacgacccggacctgaaacatctgctggaaacggaggatgacgggcaacaatagttttaaccattcattttaatttatcgaatcatggaaaagaagaaaaacagcgcgggctgtctgcccggcaaaccctgcttcccctgggtgggaggcaagagaagactgcttccggtactgatccagtcactgccggaaaatatcacggaaatggaaacttatgtggaaccctttgtcgggggaggcgccctgttcttctgactgagacagacttatccgcatatccgttgcgtgatcaacgactcaaacgagagcctggtgaatgtctaccgtgtcatacgcgacacgccggaagaactggtcggactgcttgccggcatccagagcgaataccacgcccttcagggacgtacagagagaagggactatttcatggaaaagcgcagggtcttcaacgaagagcacccggatggcatcacacgtgccgccctttttattttcttcatgcgcacctgctataacggcatctattcggtcaaccgcaagggccggctctcggtaaccttcggtacgggcagccgcgccagaatactggaggaggaactgatccgcttcaaccacaagctgctgcaaggcgtcgtcatcctggacggggactaccgccagacggaaaaatacgcgggagagaaatcggtcttctacttcgacccgccctacaaacccgtcaacgaggccggtgcctgtacctcctacatgccggacgacttcgatgacgactgccagatagagctggccggattctgcaaggacttgggagagaaaggaagcaaatgaatgctctccaactccgatccccgtcagaagaacccggagaacaccttcttcgacgacctgtacgccggcttccatatccagcggctgagcatcttccgttcggtatgttccatagccgagaagagggagacggtcaatgaactgctgatcagaaattattagtaccggtcatactctatgatgcccagtttgttgatcaggcggaaaacactgaaatcaaacccgctgtcctgcagttggagacacacgtgttttccctgcaggccagaatgaggaaactgataaaggattacggaacgcgtctaatggcctggggaccactggcacaaggcacagaccggattttcacaaatgaaacgctgaaaaatatcggagcgaaatatggcaaaaccagtgcccaggtcgttctaaatttcttgacgggtgaaggtattgtagcgattcccaaatcggtacgtacgttacgcatgacagagaatttggacattgagagtttcgaactgacagaaacagactggaagatgattcgaaagttggatacgagactgcttaaggttgatttcaatgatccggcgatggtgaaatacctattggagtataataaaaatttcaatccgggcaattgacagtatataaccgtattcatcaaaagcagacgaaaagataaatggaatatcattcttttttgcctgctttattattacatggagataccgtttgtattttatatggtgtacataaattataagtatattgacacctgcatatccgcttcctgaatataaacggaaatgcaggtgacttgacaataagcttagaacaatcgttgttgcttgtacatttggatatcttccaatttcataagttcccacaaatccggtaatattttgcgggactgcatataggcttgtattttctgttggtcttcatcgctgtaataactaattgtccaatgcactttctctttgtctatgtggctgattatttcgtcaatatagggctcgtcaaccggagaaaaagaaaaaccgtaaatataaatatgctcgattttattcattgaagagaagatgctccggttatcttggataatttgctctacatttttgcgaattctatatatttcgttgacagcggcatcacgaactgtttgagttatgtagtcttccccatcgtaccactcggcgagctcttcttccgacaaatccgccggaggctccggttggacgacttctgcagctttggtcagctcttcataagtcttattgtgaccaagtaccagcacttcatcggaagccttaccatgaatgtaaagaatttctgaatcaggaataccgtataagtcctgtaaagtggaagtgtaattaaaattgatgaagtggtcatctcctctggtcaactttatctttttacttccatccgctcttgacaaagagttaatccacgctttgaaagtgtctttaatatcattgaccaaatctcctatttcactttctgcctgatatgaaccggcataataatcccgatccctaaactcgtcactggctaaatccggctgattttccgaagcagtatactgtatgtaggttgcaagttctatttcgcctaaattcacttcaaactgccaccaccattcatcatcatccacataatagaattctctcagtctttcgtagagttccggttcgttctcttcgagccattgacggtacgcactataactactatttattccatgatggcaatcgaatccatttcctataatatacaagtttttcatttaagtatttttatgagttaattctttcatttatgcgaagttagaaaatagttgtgagtctaaaaaaaaattatcttctttttttgatagtctcacttttttatttttttttgcagaaaatcaaccatcataaattatgggcctcaaagattacataaaagaaaaacagaaagtttttaagcagttgaattctgctatagataagacattctcagatgatgctgaagaacgtaaggaaggaagaaaagaattagaaaagttgcgcggtaaagatggagtcgttccctttgccataggttatgcacatcaaatagaatatgactacacaggaaatccggaggacgcacgaaaagctgttgaggaatacaagcgcatagttaatgatgggtatgcttttgtagcaaaaaacattcaggatttggaagcccgattagagaactaattgtatatgaagcggaagtatttcattacaaacagtagattgtagcttgtttgattttgtatccacattaagaagacgtctgcccttatattgtatgactgcgaggacaaacgtcttttttgtggtagttcagtggtcgtggtcaagcataatataccagccgtctttgataggtttgtatagagtcgtacactatctgtttggcaataaatatcattcaaatccgaatgttgttctattggcggtatttgctttttatccagttccgattcatagagaaatacaagaaaccaaaaacactgcagttacagtatttctttaatttcgtatttacgtatctgtctacctctttatttttcatccacaggcttgccctgacttcgtacggtccgcctgagaagattttatcctctcctggaggaattcgttcaaatccttgtgtggcagatagtgtacggccttgtcaaccactttttcacacagccttccgatctcctccaccgcctttctgccggtttcatcattatccaggaagcaacagacctgtccgtaacttttaaggatatccactgccttgggcaggttggccacagaattgagcaccacgcagtccggcacggcttgcccttccttcaaggccaggtacgagagatagtccatgaacccctcgaagaccagtaccggtgactgccgtctatccccggcattatggctgacatgtgtgatgtccttgggggaaaccgcacccttgaagtacgggttgcgtatttcaagcccccctttcctgtttttgaaaccgaccgcgaaataccatttgccacgcatgcggtaatgtacctccacgcattcccttgtggcgatatcggaaggaatgccccttgtcccgagataatccagcaggacggtgttcttaagaggtgagacgcgcagcccctcaaaaggcgatgccacagcccgtcctttcgcgggagaggaaaccggcctaaacgccggaaaatcgctttcaatcctctgcaatacggtcgggatatccgtcaccccgtacagcttttgcgccaggtcgatgatactgcccccggttccctccccgaaatcatgtcacaggttcagggaaaggctgaccttgaatgacggggtacgctcccgcctgaaaggcgaaaggtaccatacactgtctccctgtcttctgacaggtgagaatcccgcccgcccgaggaaatcctccagcggaatcttctttgcttcctcgatgttcatcgcttgcttgttttacaggttatttaaaaggcggccatgatagcgggtccagcaagacaccgtccttccttaactcaaaatgcaggtggttgccggtcgccactcccgtatgtccgacattcccgatatgctgtccgatacggacatgagtgcccgcctttacatgcagcccgctcatatgcgcgtacagtgtcgagtatccttccgcatgccggacatgcacgaaccaaccgtaactccggctgtagcgtgcttcggcaaccctgccgttccccgcactgtataccggggtgccatagggagcggccaggtccactccctggtggaacagcctccttccctttaccggatgcatcctcataccgaacgaggacgagaccctgaaacgggtgtatcttctgtcaagggggaaaagcacgggataatccgtcaggagaatggggacatgtcgggactttcaaggaaccgttcactttccggcagtaccggtggaatgtccctttaacaattcacccccgtttccgccagccgtaccgtctccccttatacaggaggaggctgacaaaaggtgacaaaacatgactatcaatgacaactttctcataatcagaatattttaagacgaagatagtaattttatctcccgaaacgatttatccactttaaaatttaacagtatggaagaggtaaaaccggctgctacaggcagcgaaaacgccacccaggaacagggttacctgatggcttacgacaagaaggaacagaaggcgaaaggtgtcaagggcatcgcggcaaacggagagctggagacgctcgaggccaatgaaacgaacaagagccagtttatccgcgtggaccggcatggaaatttcttcaccaacttcgggaagaacttcatgtaccagtacaaccatccgacacgctatgcgctgtaccggatggaggagaagaccccggtggaggaagccaagcgtaggatcgagcaggcccagctccccgagaacgagtccttaagacgcgagctctcccgggataaccggatctacaacaaccaccttttcaacgagcgcgagatcaactggcagcaggccgagcgttacgggctcaccccggacgtgctcagacagacgggcgacatggaaaggctgttgcagggcagacagtccggcatagcctatgacatctccatgaacaccgagctgggacgccagaagggggatgccaagctctcgctcttccgcgacgagaacggcctggccaaattcgacctgcactttatccgccaggctcccaaggtgggacaggaataccggggatacaagctggaggaggacgtgctggacgccttgaaccggacgggcaacgccggaaggctggtagacctggtcgtcgacttccgcagcaaggagacgaaaccgtgctacctttcaaaagacccggttaccaacgagatgttcttcctcccggcggaccaggctcgctgccccaagaaaatcaagaattacacgctctcgcagcaggagtacgccgactacacggccggcaaggaggtccccatcgagttcaagtcctcaaacggaaaaatcctgcggacctccatccagatgagcgccgccgaacgcgggaccgagttcctgtgggaaagaagcacgaagaagccggagaacagacaggggcaggaacagaaggacggctcgccggagaaaacgcagaagcctgaaaagaggacctatgcacgcaaatcaaagataaccccgaaaatgtaacggcatggcatccataaaagacaacatggaacaactggaggagctgttcaggcaggacggcggagggtgcctgctcgtcgggtacgaaaccggcatggacaagccccatgctgcgatttcctaccagctttaccctgtcaatccggatcaggacggcatgacctaccagttcctcagcctgctgcatgtcgggatggagaccgcccggatatcggctttcgtccccgatacccgtctggagatctaccgcttcccccgtatgtccgatgtcccttccatatcccgggacatccccgtgaaggaatacatcacaggcaaactgctgccccatatccaaaggtgcggcctggaaccggtggtgagcgtcaacctgcgtgacgtggtgttcatgaggtccgtcctgaaacggtccatggaaccgggcggacggctgcggctgacggccgcagagatcgaccgcctgatagatttccgccggcagcaggacgagaaggcgcggctatacggctatgagcccgcctacaggctgcccctgcatatcgtggaaacatcaaggggcatacttgttttcagtgacgggccggcgggccggaaagggctggaggagttctaccggcacctggcggacaactactggtggatacacagcgaaccgggaccggtcaaacaatatgacatgcattccgttccggcaagcctggccccgctgattgacgcctcctgcagaaaagatcccgataccggaagatacgtgtacgagttcacggactccccggtacgggcggacctgcccgatgaaagaaaactggagccggtcttctttaccgacatgacgccctccgctgaaggataccgcaacctcacggagttttccggatgtgggatgagcgggtgcaacgcggatatctaccggctgctctcccttacccgccacttcgaccggcagctcattcttgaccccgccttttcctaccggcaccagttccgggagttcgtggaacgcatggacagctttctccggggaaatcccggcggcgatgacatgggaaagatactggatgacatgcacggcaaggcggggcgtatcctgaaaacggatttcgacgtaagggggcaccgtaccctggaacggctcctgaatgaccgcagcgtgccgttcctcatcggggaacacgaggccgatgacactttgagaagggcgctgctcgaagggagatggatttacttccccggactgtcggcaaaaatgcccggactccgttacatccatgccgataagacctgcgaccgggtcatggcctataagaatcccccggggctcaagcctgtataccagatcaaggacggcaagatcgtcccttatgagtcggaggcagtaaaaacggataaagcgcgggcaaagagaaacgggaagaggaacgggaacaatttaaagttatagacatcatggagcagacctacacagcgatagagaccttgggcggcttcctcgcctttaccgacacggcggaaggcaggagaaagctgcggcagttcctgcaacagacggccgacgcctatttcaatccggcattcaattccggagcgttacgtgtctacagggccgaaggggaacttggcaaccgcccctgggtcaacccggggaggatgcggccggacgagtacccctatggcccgaagcctcatggcgaccggatggaactcctctacagaggtgagatgagacccactgcggaggacttccgcagtttctgccataatgcgggctgtgagataagtgcccgcaacgtcaatatcacggacaccctggatgccctggagcgttatgaccgccgggtggaggagttgcaacggatacccgcaaaatccgcccgcgacagggaggaattactgcagaccctcgagaccaggaggcagctgcagaaactgatggactccgcctatgatgtccggggataccggacggccggaagaatactggacgacccggcggagcgcgtcaccctggaaggagtcccgctctacggacctcacaggagcgtactgaaagagggcctcgggctgtatctgccgcacgaaagcgggaacaacccctcgcatgcctacgcgtgggtggaccaagctacggaccggatcatcttcggcggcaacccgcctgtggaccggaaaaccgtcaggatcagaccggaggtcgagaagaggctgtacagcccgccaggaaaaacacgtaaaaggaccgggacacgtcccaaaatgtaaaataagaaacagatgacaatggaaaaaagcaacaggaccgcacccctaaaagtagtgctccgaaatcacggttacctgctgttctccggcagcaaggccggtgaggaggccctcaggggatatctccagcgtgccgctgacaggtacttcgaaccgcatgctcatgacggggtgctggagatctacgagtactccgggcggcgcagggagctgatgccccatatcaacggcggcggacatggcatgtcctgccgggaagggacgggaaaggcggaatacattccacgggaggcccttcccgcctggtttgccaacagcctcgagccaaggctctaccacgcgatgaacccgacagccgacgaataccgggggctgttctccaaagtgaagggatatacgggtttcgaactctcctccagagcggagaacgaggacatataccgcctgctatcgatcagggagcgcggctacatgaatatccatgaccggccgttcacctattgcagggagctgcttcccctggccgaacggttcgaagaggtgacgcaggtgaaagccgccgagctgtttgacccgcaggctttcagggcactttcatccgagataaggaaaaaggcggacgatatcctccgccgggactttgacgtaaggggacaccggtcgctggagaaatacctcagtaatcccgacaccgccctgctcgtgggaaacgtgaggctggagaacgagcagttcagggtgctctccgaaggccacgccctgtaccttccggagaatgaccgccccgcctcacggcacctgctctactgcatggcggattttacacggcacaaattgctggtatccggtgaaccgttccctgtcaggacctaccgggtaaaggacggcatccgtcatccggcagggcagtgtgaggagttatcgaagaaaaggaaaaggaccggacagaagccttccggcagaaaattataaattaaaacagtaccaccatgtatatcggattcatattgaacggcaggaacaatctggaatactgccggatgctgtcttctgacgcaaacgacctggaccgccggttcggggagttctgcttcaaccaggtcaggaagcagctgaaaggggcctacctgcccgaggaaaggatctactgcatcgaggccgccggtggggataagaaccgggtggaatcccttgtgcgggatataatcgacagaggcgcgtggccctccgacgactaccagaggctgcgggatatcggatttgtccatgagacggccgacccttacaggaggaccgacagccgggactttatcgtcggcgagcttgaacggacgctccacaacgggaaggcgggcagactgctggaagcctaccatgacttccaccaaagccgcgagaaggataccggcaaccgtgtgcttacggccatacagaccggacagggcgtgctgctcttcgacgacacaggccggggactggagcgggcggagagctatctccagtataatgcggacaacttcttcagcccgatacaccgaaataccgacaaactgggcgtctattatttcagcacggacaacgcaaggctggtggaaaaggcgcgggagtgcggcaggatgtttgcccccgacgacaggtgcagtttcatccccgccagggcggaattcctccgggcggacatcctgcggggatgcaagcccgccgtggagtgcgacatgtcccccgacctcgcccgataccgggagatgctgaagatattcaagctcagggaaagtgagacacccttcaacatcggcatactggacaggctgtgcaggacgggaaatcttgacgagatgccggaaaacaggaacttcaggcatttctgcagcttttcctccctgcgctcgcagatgagccattccttcctctcctcactggcggacacgctgctggggaattccatgagacaagccgtcagcgatacggcacggcgcatcctgcagaacgaatacgatgtgcggggatattcgcccaccccggatacgaggcgcaggcgggaaaagaaaccggaaaagacaggtaaaaaaactaacataggaagataatatggcctcgtggttggaaaagctgggactgcaaagaacgcgtccccaaaaagaagagctgaaggacttctgtctggaactgtgtccggacaaccggatagcctccttcatgataacggaccatacgccccggagcggagaccccttcatccggttcgtcaaggaagcggcccgtaaagccgtactcgaggaagcccggggcatccccgacaacctgctgctcttctatgccggcatccggaaagaggagctgccccctgccgccggactgcaggagaaggaacccaggcaggcatggcgtttcatcatcgaaaacggcgggatcacggacggcaactccgtcccgctgagacgggccgcctatttggaggcacacggtgtggaaacggaccgcaggaacctggaagggctggaacactcgccaggctacaaagacttcgtggcatacgagaccgcacgggaacgtatccttcaaggaaggagcgcccggttcctcgtgaccgccgtaaagacggaccagggcgtcagggtgttcaacagggggctgcacggcccgcgccacctgcacgaatacctgcaggaaatagccgacaatttctactcaccctgtggaaagggaccggggacattgtccatattccgcatcgagacctcgtcaaaacggctgatggagatgtcccggcagcccggacggtacttccccgcctcccagcccggactggaagtgttcggaagttaccgtccggtagcctccttcgacctctcgcccacggcagccaacctcgacaggttcgttacggccggctccctggaactttccagacgcaacctggatatcatgacattgcaggacatcgcggaaaagggatacgcccacctggcgctggaggagccgttccgttacaggagggagttcgtccccgtggaaaaagaactcggaaggctatccagggaaaaggagctccatccggactttcccctcggggagaggatggcggagctccgggagacttccaggaagatcgccgccgccctgttggcaagggagggggtccggacagggatgccacggtcggaaacgaggtatgccgacaggatatcacgcatgctggagagtccggcggataccccgggggcggccgataccggcaaaaagagaaaacaaccctcttccagacggaaacatgccgaaggaagacaagtaaaactgtaaactgcaagcatatatggcaaccaacaaaccacttaccccggaagaagccgtcgacatgggccgccgcgctgtcggccgacgggcattgatgcggacactgagggacatcttctcgtaccgtaacccgctgctgcagttcatggacgcctaccgcttcaacgtcatccgctggagcgcgtccaacctcagggaaccgaccctcggaaaacgtgtcaggctgttcctcggcaccagaaacccgctgcggattctccgcgacaacttccggcagaaccgcgcggacctgacagcggactgggaaagggcggtcatcggccgtatcaacctctcgctggaagagctggggagcatcccgctgcattccaggccccgtgaccttgccaaaaggctggaccgtgtcgggaggatgataaaccggatgaccggctatgagcattgtcccagcctgctcacggagaggctgctgctctccacctacaggtatatattcatggctccccatgacaggcggttcggcgccctctgcccggacgggatctgcgggatgctgcggcagaacggcgtgccgccggagagcctgtattaccagaactacgaaagcctgctgcaaggaagggagacggtcatctacgagttcacctccaacgggaaagggttacagtatctgcgtcccctggaacacgtgaggctggatgccgacccgggcgggtacgacatgcttcccgcccgccgggccgacagcccgaaggccccttcgattccctatggggcggaagaggccgtgccgctctccgaaaaggcgggaaaaaacggaagggataccgcaagggagaagagaacggcccggaacacaaaagtcaaaaagacaaaggccaaaaacaaaggcatgagcatgtaaccaattattcacctgataaaaacaaaaattatgagaatcgtacttacagacaagccagccatggcaaggagcatcgcctccgtactgggcgccagtgaaaaggcggaaggatatctttacggcaacgggtatgccgtcacatgaacttacggccacctgctggcacaggcaccaccgtccgcttacggacccgcccgtgtggaacggcaggcgcttcccctcattccggtcccgttccgtctcgttgtcagacaagtcaggacggaggaggggtatgtcaccgacccggtagccacccggcaactggaagtgctccgcgggttgcttgaaaacgccgacgggcttgtcatagccacggacgcagggcgtggaggagaactggtcagccgggatctcctggactatctcggttaccgtaaaccggccctgcgcctgtggatatcctccctgacggaaaaggccatcctggacggtttcaaaaatctgagagaggacagcgacttcgacaacctcgcccaggcggcgagggcacgcagggaagcggactggatactgggcgtgaacgcgagcatcgccctggggatagccgccggcatgggcaaccactcgctcggacgggtgcagacacccacgctggcattggtctgccgccgttatcttgagaacagggattttgtgcccgtgagctgttaccatctgcagaccgatgtctgcaaggacgggcagaaagtgcttttcacgtgtcctctccggtatgaaaggaaagaggatgcggaaaaagcccgggtcggactggagggcgaaagccgttgtacggtccttgccatggaaaagaaagagatcatggaggagccacctctgccacatgacctgaccggcctacagcgggaagctaatacacgcctgggcatgacagccggacagacactcgctgtcgtccaaagactttacgaaagagggtgcgtctcatatccgagaaccggatgccgccacattccggaagacatcttcaagcaggcacccacgctcgtcgccacccttaaagggcatccccgcttcggaaggcacgcggaaaggctgctcgggaaaggactgaaccctcatgcggtggacggggacagcgtggcgggacaccatgcccttctcatcacgggagagatgcccgaaggactctccccggacgagcagaacatctactccctgattgccgggaggatgctggaagcattttccgaaggatgcgtcagggaagtcatacgtgtcagggccgattacggaggaatggaattcgaagccgaaacctcatgggtgaagtatccgggatggcgggacatttacaacggaccggacatggcggaagaaggcaaatccctgccgcagttccatcggggagagacgctggcggtattggaaacagagatactggaagacagtacaaagccgctgccaccatttacggaagccggactgctggctgccatggaaaacgccggcggcacggcggacggtgaaaacaaaaagaaaacaacggagaggtgcgggctcgggacaccgggcacccgtgcaggaatcatagacctgctggtggcacgacggtacgtagagcgtatcggaaaccgtctcatcccgacaaagaaggggctggagatatacggcatcgtaggagacaagctgatcgccgacgcggctatgacggccgcctgggaagaggcgctgcgtgaaatcgaggaaggaaggctcagtgccggaaagttcatgaagggtgtccatgagtatgcacggaagatcgtgtcggaactgctcgccctgcaggtcaggaacccgggcgtgacaaggtgcgcctgcccgaaatgtgggacaggcaaagtgacactctacgacagggtggccaaatgcggagatcccgactgcgcgttccatcttccgcgcatgttcaacggacgggagatgacggacgaagagatgacacggctgatggtaggggaagctaccccctttctgaaattcaccaccaaggcgggaaaaccctatgaggcgtcgctcagaatggacgagaattacaaggtggagcttacattcaaggacagcatgcgggagctgtaacaggaccgatactgtaagggaaatgtcccggcctgctcttttcggagactggccgggattttccgttaatcggggtgtatggaaagtccgtatatcattacaaccgtctcgggcgttaccacctgatgtgtaccgacggtagctcccaccaagtgaacgtcgggtttcctttcccgaagtgacggagcggaaaatgccagcggcccgcttacggaaaagttcattgccgatagttcaaggagctgttgtccgtaaggaaatgaacaggctgggccttggagtacggatatgaggtagctcctgccgcaatctccattcaatatcctgtatgtaaataatccagacggcagacacccgtatcgaaatgtctgtttccaatcaatttccagacggaaggcgcaagagcgtctccgaacagcctgatacctccctgcagtctcgggataagatagatcaccatctcgtccaccatccagaacctgagcaggctgtcaacaagcgggagtgtgtcagggcaggcctcgacaagggcaatcccatccccttcctctttccatcgggagagtgagacgaaagataccggtccctcaaggtggcgtaccgccttcttcctgatccgggtgataccgtatttctccgcagaatcctgcaacgcggagagggactgccgctccaacaggcagccgtcaagggagagaaaggccataagctgaatctttgccataagctgaatgtttaatgataccgtctacttcgcaggcaaaatccataaaaaaaacgtggacttgcacagtgtcaagacgaggctctggtaagcccagaataagaactgtgcaagccacgctatgacaatgcatagcatagccttacacagaaatcccttattctttgaatttaccagattccgtcttgaggatgttctgcgaacgttatgtctatatatctcaagaaagaaggaaaaatactccttcttttcccaaactcatattttcgttccaaatataggaattattctaaaaatcacgaaatatcgtccggataatcttcccgtcaaggattggaaagggtatagtgtttcacgacgggcttccagaaaagcatatgactattagtgactatacatgacaatgcatgacacgggaaagtaacatccctctttctttactatcttgcacccgaaatcactaaaaaaatgaatatggaactgacaattatcgaaacaagcgcttatctggaattaaagcggcagctcagcacgttgtccgtgcaagtggaggatctcgcccggaaaatggctccacctgttccggacaaatgaatggacgcgcaggaggtatgcctggcattgggaatctcgaagaggtgtctccaggcttaccgtgacaggggactggttccctgctcacatatcggcggaaaatatttttaccgtgagacggacatacagcaaatcctggaagaaggactaatcaaaaacagaaaataacagatggcggaaatcattaccaaggattcggaggagttcaaggaactcaccggatggatcaagagatgtggaagggcactggaaaacgcgacggctcgaatccgtccgggcatagccgacgagcattatctaacgggagaggaagtctgcgagaaactgcatgtatccagaaggacgcttcaggcactcagggacgagaaggcaatcccgtacacttccattaccgccgcaggaggcaagctgctatacccggaaagcggactgtacaaggtactgaaaaagaactacaaggacttcaggcgatatgccagataaacaaacggcacgtattctgaacaaaaaaactccttcggccggattcgaggctgaaggagtttttatataagttccgggacttagttggccagccggtatgtgtcaccgatcttcatgcacagcctgtccgtatcttccccgactttcggattgatcagctcagcataaatctgggtggaaagaatggacttgtgccccaataccttctgcaaggtttccaacggcatcccctttaaaatggccagaacggcaaaagtgtggcgtccgatgtgcggggttatcccggtcgagcagccgcatattctggtcaggaccctcagactggatatcatggcctggtattcgcctacgggaaacaccttgtcaggcgaacttttcttttcattgtcacccctgtacttctcgaccagttcgatggcgataggaagcagcttcaccacataggccacgccggtttttatacggtttcccatcagccatgtaccgccctcggaatccgtatggatattcttgtacgtaatctctttcagatccgcatacgccaaacctgtaaaacacatgaacaggaacatgtcacggatggcccgctggcgcttgtacttcaacttgacatggatgatgctttgcaagtcctcctcggtgaggaaagagcgccgcttgtattcgggcaggcagtcaaaaccgatgaacggatgaagccttatccagcctctttcctgggcggtatacatcagccatttcagggtgttgacccggcagaaagccgtcgaattcgccagggcgcatgtcccgagcatccagttataatagtcctcgatgaacttcttgtcaaggtcggcgatggctatatcctcgatgcgcctcttctctttgaggaaaagcaacagattcttgtagtcggccaccagcccgcgataggtgcttgccgccttttccttgcctatcttttccttgtaggagacaagttgctccctgaacaatcccataagggtgtgataatcgtctccgaagccaagatagcggttgtagacacttttagctgtcaccaggctgtcatggtcacagacatactggtaatgccttgtgatttgggccttgatattgtcaagctcctggttcagccgtctggcctcgtcggatttccccttcgccctcttggccttggcatcccataatgccagtgaaacttcccgcttgcaactgaagcaggcggtggtcttgttgatggttatacgtcccataatgggcaccttaccgtctttcaacgattggttcttggtgtaaaacaacacggaaaatgtacttctcataaactcacttcttttagttacaaaattaataaatatcgagcttttcgaagttatgaaaagtaacgcaatgcattgaaaaataatcgtttatatcccttgggatatccgtatttgcaaggtaacggataagtaacggaagtcgcagcaaaacatgccctataatgctcgctttctctaccaacaaccaaaaacagaaatcaataactatttgattgttaattggttttcgctacctttgcaaactgtggaaaaacacttagtttcatctaagaaaactaaaatttcgtgctatagaaaaaaatgtttctctcatataaaaccagcctgttatttaacgaaaaagggatgagcttaatatcaagtccatcccttcttattacaatcaacacgtttctcttatagctcacgaatccagatattacggaagctgatcggctcgctaggatcgccatggctctgtaggatgatagggcctgcgccatgtttcttcacttgtgggaaaccgatccactctgtcgtacccaatatcgtcgtatggttctgcaaaaccacgccattctggataaccgttacggttggatgcgtgcgataagaaccatcttccttgaaagtgggggcggtataaatgatatcgtatacgttccattcgcccggtttacgcatggcgttggccaaaggaatggattgtttgtagatactaccagtctggccgttcacgtaagtcgggttattgtagcagtctaacacttgaacctcatacatcccttgcaggaaaataccgctgttacctctcgactggctctcaccggtaatattcgtcgggacctgccactcgatgtgcatctggaaatcgttgaatttctgtttggtctggatgtcacccttcttcttgtttacggtaaatacgccatcttttacatcccattcggcggcaccgccctttacgctctcccaagcggaaagatccttgccgtcaaacaaaacgatagcgtcggaaggagccgtgaaacctccaccttttaaatctgtacccggagtgactaccggcggaacaggttcgtaaaactcggacatctcatgcgtgatacccgcataacctgtaggcatcttgaactcttttttcttgtcttgagcgacaacggtaacgcaacccgctaaagcgaaagccgcaactgtaagcaatcttttgttcatggtctaaaatgatttattagttagttaacatttcttgctgcaaatataccgttttttgccgagactgataacgatttgtcagaaatcttattgattatgatcaaataatcttttctcggccaactgctcaaacttggtgttcggacgaccgtaattgcaatacggataaatacttataccgcctctcggtgtgaatataccagtaatttcgatatatttcggatccattaattttatcaagtccttcatgataatattcacgcaatcctcatgaaacgccccatggttgcggaagctgaataagtaaagcttcaagctcttgctctctaccattttcacgtcggggatataatcgatatgaatcgtagcgaaatccggttgtccggtaatcgggcagagactggtgaattccgggcaattaaaccgtacccaataatcatttccttgatgcttgttcgtaaatgcctccaatacctccggagcgtaatcctgtttatatacggtagagccacctaataaatgcaactctccttcttgttttctctcgtccatttctttcatttacttttgattctcttctttccttttcagatatttctccaatccgtccttacgaagtttgcaagccggacaatgcccacatccctcagccataacaccgttatagcaagtcagcgtctgcgtacgtactagatcaaagacgcccagttcgtccgacaattcccagacttcgctcttatcccggtccataagcggggtatgaattacgaattgctcatccatcgccagatttaatgttacgttaagagaacgcacgaacgtatcccggcaatccggataaccactataatcagcctcggagacacccgttaccaaatgataaatccccttaccacgggctaagatagcggcgaaagtaaggaataccatattacggccgggcacaaacgtattcggatagctatcctccggcttctcttgatccatctctatgctcgcattcgtaagcgagcaattgggatctaactggctgataagcgatacgtccaataactgaaaaggtacgtccgcatccgcagcgatctttcgagcgacctctatttccaaggaatgtttctgtccgtatgtgaagcatacggcctctacacgtgaaaaatgcttcttcgcccagaaaaggcaagtcgtggaatcttgtccacccgagaagcataccaaagcggcatcttgttgtttcatatctttcttgtttttaatacgtggtttagcaagcacacggaaaagacatcttttcagccacaaagatacgcttttttttaattctttcgagcggcgataagcaacatcatcggacggtgaagttcgtctcgcatcccgggaaccgtatccagcatcgattcgtccggttgaggctccaccagatgggtgatacagaaacccgccttgatcaatccgttcacgtaagtcgtaagtgtcttatgatatttggttacatcctctcccaaaaaacgagcatgccggactccctcttgaaaataatgatccaccggccaatgcgcaggtttccccgccgaatcgtaaatccaatcttgattgccataagcagtaaaaacgggatgttccacagagaagacaaagacaccctcttgcgttaaacatttatatacctctgtacaaaccgtatcgaacgactcgagataatggaatgtcaaggagctgatcacgatgtcaaaagaatttggagcaaaatcaaaatcctcgattgctattcttttatattcgatcaacggggaggaatttatctcccgtgccttgtctaacatcttcccagaaaggtcaatgcctaaagcgaaggtcgcccctcgctctatggcatatcgacaatgccagccaaaaccacaccctaaatccaatacacgctttccgttaaaatcaggcaacatcttctttagctcatgccattctcctgctcctctcagcccttgtacagagcgagacatctgactgtattgactgaaaaagcgttcatcatcatacttattttctttcatattatatattgtagggatatcttggccgaagatacttatttttcgtagataccgacatgatttccttcgctatcttctaaaacggcgaagtatcctttattttccgcttcaatctttgtcttgggtataataattttaccccctttatccaatactttagataaagtgtcctcgatatcttggctattaaaatggattaagataccatccggcgaaggttgataactaggagcgtagaacaaagccccaaccacttctccttgctcgataaaacaagccatcttctctgtctcacactcgaaaaccgatagttttaaccccaaaatagtttcatagaaattgatcgctcgataaaagtctacagttggaatctcgaaaaaagcaattaaattgttcattttgttttctttttatagttactgttaatgtcctcgcgaagacatcacaaaagtagagcgtatcgtatctataggatagaagaaaaaggacatcttgatcactccgagaaataatcagaataaggagcgcataaggaaagatactccgtgggtgtatagccggaaaacagcttaaactcttttatcatatgtgactgatcagaaaacccacattcataagctaattgagcgaatgaaatggatggattctgttgtaccttaaataaagcccgttgcatcctaacgatacgaagaaactctttgggcgtagctcctacataatctaagaaaatgcggttgaactgtttagaacttaggcatgcggtttcagataactcagaaatattagttttcgcttgttcatttatttgatggaggactgcggatattcgctttaagttatattcatagccttcaaacctataaagacggtgaatcaaaaactgctcgatcaagcggatgcaagtttcatgatcatcagcctctatcacttttctggataatattgataattccaaatcttctatagcatccaccgctataagttctccataaaagaacttaaggggaagttgaaggatggctcttgccgcatacggctgaaaaacaaccgtgatcatttcaatctttccggctgacatcacatctgaaaagttgaggcattgcccacagatgaacgcttgaggctgcgattctttttttcctactaataaaagccttttacccctatgaaatactaattgtatgcagcccgttggtaaagtccgttcagatacagaaacatccgcgccatcttccagtatccaataatatcttacataaggagttaatatatgaataggctttattattttaaatgactgcatcttatagaatttaatttatcggggcaaagataaataacccctaatcaattctatagtaaaaaagagacatttcatattaatactgcgacattaagcttcaatcaactatttttgggtatattcaaaactgtagtatgcttgatttcattaagcacaaaagagctttgcatcttcacgatgccatgaaccttggttaatttctcgaacacaaattgattataggcatctaaatccttaagaaccactttgacaaagaaatcataaatacctcccgtcgagtaacattccattatttcatcgatattccgtatttcttctttgaagcgttcgatatgctcatcatcgtgtacagctaaagatacattacagaaaatgatcaagggtaatcctatttttttattgtcgaccaatgccacatatccttttatatatccttcgttttctaaacgtttgattcgttcgtaaataggagtcttggagatatgaagtttctcagaaagctcttttgtattgatcttcgcgtccttttgcaaagaatgaagaatttcaatatctgtctcatcaagtagtgccatagtttttttcctgttttatttgatttaatatccccgaattagaattatagaatgcaaaacaggacaaaaataggaaaattatcgtatttaagcttgacgtataggaaaacaatcttctttaaataactttgcagcaaataaaaatctaattctaacacaattatgtttaaaagtaaagatcttctgtatcatagtatcgccatattgacagtcattatatggggaacaacgtttgtctccacaaaaatactgattaatacaggattatcaccggttgagatattgttataccgtttcgtgcttgcgtatttttgtattttgactatagcgcatcgacggttgtgggctaattgcgtaaaagatgaattcttattgttcttgtctggattatgtggtggttccctatacttcatagcggagaatacggcactgggcatcacattggcttccaacgtttcattattgatctgtacagcaccgatcattacaacggtattgtctcacctattttataaagaatctcttaggaaaggactgttatatggatctttagttgccttatttggagtcggattagttgttttcaacggcagtgttcttttaaaagtaaatccacttggtgattttctcactttagttgccgctacgatgtgggctttttactgtcttatcctaaagcgtttgagtcgttcttatcccaccttgtttattacacgaaaagtatttttttatgggatactttctcttttcttctattttgcgatctaccctttaaatatcaaactagagttattgaaactgccagtcgtatatttaaatatattatttctgggtgtcatcgcctcaatgctttgttatatcatgtggaatacggcagtcagagccctcggagcatcaaaaacagccaattatatttacattgttcctctggtcaccttgataacttctgcgatttttctatcagaaactattacgatagcttctggtattggcgctttagccattattagtggagtttatatcgcagagaggtaaaaataaagaagggttactcatatgagtaaccctttgattttcagtggtgccaccagaaatcgtcattttgacttaagtggctgtatttcttatagatatattttcaaaaaagaagtaatctcccgctattgctccaccaaatttttgcactactttgcggcgaaattcttcacaacacatttccttttgcaaatatacgaggaatcgtcataatttggaaatttaaagaatagttttattgactattatattgaaaatatccccatcgaagcagaaagttgcttcatattgctacaaataaagcaaaaatgtcctttttgtacaccgcaatcttaaataatatgctttatttttgcctaaattgtttatatggagagatttttgtctatatcgccatcaccattacttgcaccgtatgtcaaggaatattggtttctatccgcagatagcacaagtcaaggcaaacaacgtgctattccttctggatacgcaggactaatatttaatcggggaggtaatatctattcggaagaatacggcttgtatccgaagtcatatctttttggacaatccgttagacccgtaaatatgtgctttgacaatctgaatatcgtaatagtcgttttccagcctattggtattaaaatgctattgaatatgtcaggtagtgagcttaaaggacaaaatgtcgggttggacttactaagcccacgatttaaagaattagaaatacgtttgcttgacactcctgatgagcaaagagttgtctgtttgatagagaattttttgttaggatatctcaatagtggcgaagattataactataagcgatatacttcagttattcaatcaatagaaatgggagaaagcaatatttctaaattggctgacagagcttgtcttggatataaacaattcaaacgacttttttcagaatatgtaggattaaacccaaaggagttcattcagataaaccgattttcaaaaacgctacattcgttgcaaacgaattcttcagcaaatctaaatgaaattgcttgcaaatgtggatattacgacaaatctcatttaataagagaagtgaaatttctgtcaggatacactccgaatgagtttttatcaaatgcagacccttattctgataataggtcattgtttcaatctttttttgtagatataagaatataagcaacccaatatgaaaatactaatttacggagcgggaattgtaggaactacctacggttggcaattatcaaaagcgggtcacgaaatagctgttttggttagacctgaaaagaaacaagctacaaaggaagaaggcattcatatccactgtgcagattttagaggaggaaaaaaggaaatagaggatattgtttttaagcctgatgttatagattccttgtcagcagataacaattttgaatacattattgtaacaacaaacaatcttcatttgaaagaaatactacctgttctctccaagtcagcaggaaacgctcatattcttttctttcaaaatatgtggattgatgatttggatagcattaataaatatctttccgagaaacaatattttttcggatttccctttatggtaggcggtggcagagatgcaggttgtatatatagtgctatttctggattaaaacaatcgcatactccattaggagaaccgaatggagaaatatctgaacgagtacggaaaatagctgatgcatttgaagatgctaatctcaaaccaattatctacaatcaaattaaaatttggcttataacccactatgcagttgctgctggattgtctgcgggaatcatgaaagctaaaagcggacggaattttgcgagcaactctgatattctaaaggaagcaataaaggctatcagagaagggttagaggtatgtcaaaagttaggttataatccgaaagcagtaaaagctaatgggctttactttttacctttctttattgcaattccaatagccaagaaggtttatggtaatgaagcattatgccttatgtttgacgggcatacccagcattcacctgatgaaatgaagaaaatgtttgaagacattataacggacggagaaaaacacggagttaaagtttacattcttaagcaaataaaagaggggatattcaattaatgcattaatcattcagtatacaaggctgttccttgatataattcaattaatttatgcttatgaatgatttattacaaatgaggatattcggactattgtctgaaacctcacaggaagtaagtaacgaagaaatgcaaaatgcttatggcgaatttgttgaacaaataagaatcgtgggggatggaagtgattattccacagtctaccgtattcttgtagctacccgtattgagatagcctcactcgaaacagtacctctttacggacagggggaaaaatgcgcttaaaaagctattcctacaaaagacactggcaattattagcacagaactggaactactaaatttcaaaattacacatcctgaatcgtttcctttggcaactccattgacatttgaatcacctttatcggtcatacctaagttccaacatcttggaattatgggtatgactgaaattctttcagctttgatgttgtttggtggtatcatcgacaacacaggcaagaatccaactatcattgctttttcggaagtctttgaacaggctttcggatttagttttaacggtatctatgaccgtcagagcgaacttttcaaacgcaagccatacaatctcaccaagacactggatgctttaaaagttgtccttattaaagaatataagaaacgacaagcggaaacactgaaaaataaagatgaaaaaagatgattttgcaacaggttgataaataataatttgcatttataatatagaggggtcaataccggactcctctatttttatttccttattcttccgtcctttgtttcatcaatcgattggaaaacttaatgttcaactaaaaaatgaagcaaaatgtatatagacaacgaaaacttcgacaagtggatggaacgactatctaaaaaactctctgaaatcgggcaagacctgaaatcgcttatcaatactgacaaggtattggacgaaaatgataagatactcgacaatcaggatttagctttcctgctaaaagtatctttccgaactctgcaacgctatcgggcaagtggcaaactcccttactttacgataagccataagacctattatcgggcgtcggacattcgggcatttgttcaagaaaatgccgattgtatgacctatgagcggttcaaaaaggagaatcagcttgataagcaaaccgaagcaaagcaaggtggatgatattaccgcctgatgaagttccaccgctccccatttagcagaaaccgccttgccctgtggctcggctcgtttcgctaaatgaagcaagagggaactggacaagtcctgttcttccctcttgccctgcggggcaaagccttcggctttaatgggttacattcgtaaccatttataacagtgattataagtcgaaaacgtatttcgcttataatcaactgaatgaatatcactttctttataaaaaagttataatcatggataagaccaataatatacccacacttaccaccatcggaatagaccgactaacgagtaagttaatagataagctctgtaaacgctattcgatgaaaaaaggggaaatagtccggttggcatttgtctatattgataaagcctgtatcaacccatcggaagcaccggaatccgtaaaatcggaactggcgaagataaacaaacggcaggatgatattatccgcttcatccgacactacgaggaagaacaactcaatccgatggtgcgaaccgccaattctattgccgttcggtttgataccattggcaaaacattagaaactcttattctttcttggctggaaaccagtcagggaaaacaaacagccgtattgcaaaaagtaagtgaacagtttagcaagcacgctgacgtaatcaaccagcaagggaagcaactaaacgcactctatcagatacaccaacgagattataagaagctactaaatctaatacaactctattcggagttatccgcttgtggtgtgatggatagtaaacggaaagagagcctaaaagcagagattatcaatctgataaacacataaagccatgcacatagattttgccccatcatcgggtggaacgtataacaatgcaggaagtagccgccaattagcttcatatatggagcatgaagatttggaacgtatggagaaaggtatctataccgatggctttttcagcctgacggatgataatatctacaaatcaaaagttattaaggatatagatagtaatatcgggcaactattgaaaacagatgctaagttttttgccatccatgtcagcccatcagaaagtgaacttcgggcaatggggaataccgaacaggagaaagccgaagccatgaaacgatatattcgggaagtctttattcctgaatacgccaaaaacttcaacaaaggactatccgaagcggatataaagttttacgggaagatacattttgaccgtagccgttccgataacgaactgaatatgcactgccatttgattgtaatccggaaagaccaaactaataaaaagaagctatctccgctaaccaaccataagaataccaagaacggagtaatcaaaggtgggtttgaccgtgtgaacctcttccaacaagcagaacagggatttgataagatattcagttacaaccgacaacaaacagaatcttttgattatctcaacacgatgaagaacggttctatctccgaacagattgaagtacaggagcagaactttactggcgaaaataaaaaagaagtattccaatccagtgaaagagaaaatatgattccttgcaatattgatagcaagcaaaacaataaacacgcttttaatcagggggataatagaagcggtgattctctgttatctatcttttcactgggagatggcaacaattatgatgcaacattggcagaaaacttacaggcacagaagcgcaagaagaaaaggaagaaagggataagaagatgattgaatataaggaactaagaaacgatatagaccgctacctgatggaacgtttcaagtatagtaaatcgctcgtttacctgacggtagataatattatcgccacccggagaaacagccggatagatttatatttgcgtatcaggagagtagaaagccgatttccacccgattgtctgattatcgcccgattaggttttagtaaagaacggataggacacggaacacactttcttaggttcttgaccgaagtagcccgaaaatatagtttcaattatattggtattgagtgcgccaacatcaaaagtagtgcatttgccaataaattaggcttttattccataaatgacgagaattacgcaatagcggtaaccaatctaatatcttattcgccaatggaataatcttaattaatcctttctttatctgaacacaaagttatatttcaagaataaaacggcaacaccgagccgcaagcggtttttgtaaatttcttcctttttcgtcccgaaaaagagtaaatttacaaaaagtgttgccttatttattctttccatatataggatgtttatcagagaaaaaaaggaaaaatatgttggttggagtgagcgttacggacatcggatggcagttcagtccactgcatactgtttattcagattaaagggaagattctgtataagtaatcggatgttattaaatgggtggaagcccacatttgtatataaatgaaaaatcctgattgaatattatagctctcaatcaggactatttcacatcactatttttattcttaaatatctgatacaaacaaattattacctactttctgcatatcatttagaatgctttggtctaatacacgtgcgtatcgttttgtcatgttgatattggaatgtcctaacatttttgcgacattctcaatgctaacaccattggctaagcacacagaagtggcatagctgtggcgcgctgtgtgcgtggaaatttccttatgaatcccgcacaaatcgctgatttctttcagataactattcattttctgattgcaagggacaggcagtaaaacattctgtttttgacactttggattatccttatatttctcaataatagccaaaggaatatccagtagcggaatattacacatattctttgtcttctgccgagccttgcgaatccaaaagttaccttctctgtcttttacgatatgttcagccgttagttgcttaatatctataaatgacaagcccgtatagcatccaaaaatgaaaatatcacgtactaaatcaatacgaggtaaatcaaatttcttatttgttatgatttgcaattcatcccaagtcaagaactcccgattgacttccttttcatggaacttgataccagtaaaagggtctttgtttatccactcattggcaagagataagttcgtaatttttttcaggcacttcatatagcgaatgacggtgttttgagaacattccttttctgttttcaagtaaaaatcaaaagcccgaataaactctccgtttatatctttgagtggtaaatcttccttgtcatatttgattttgataagttcggctaaatagcgtttacaactttcataacgacgtacagtaaccaaagcgaagtctttacccaccaactggcgacattggtcgttatgctcttgaaaagtagctataagtgttttaggttcttctttttcttccaagttaaagaatttatcccgaagaatggtagctgttataggtaaactttccttttttagctctgcatgtatattatacaacttgattcgggcttcttcgataaacttgttcaggtcgtttgatttgcggtctttaccacgagaacattctttcgcctgattccatagggaaggggtaatacttttacggatattcgtttcagaacgaacattattaaccgtaattctcatacatacagaggcttcaccattcttcaatagttttgttttctttaggaaaaacaaaacactaaatgaatttctttccatcatttttctacttgttttaagtgatacaaaattatggaaaagtggagagagtttcgctatgtaacatgctgacaaacagagtcaaacaaagacaaaaggtggagatgaaatatctccttatttgctccaccttttgctccaccgaagtaggttgaaatttgctgttttttgcgtagcgggtaaaaataaaaaactcccgatattcactgaatatcaggagtttacttctttttgctttctctaaaagtggtgccaccaggaatcgaaccttttatttcggtttattctaaatccctgattgactgcacatttactactttatcttttatgaaagccattgaattagcactacactaaattcatcgcttttcgtaattgtctttacaatcatcatctctttgacaacgtaaaggtagataaaaagttcgatttccgcaaatgtcaatagggatttttatgaaatattttttgctcaaacctgataatgttcctaaaagatggctaagagcctgtcttaatcttactcaattctattttgagagttttatccaatatctttcagccataggctgtagcctgtctcttattgccttcatcacagtatcgaaatcaagtgcctctttccattgaatttttctaagaaaagccttccaacggcttatgcgtgccccgtctgtagcaaaactatccgtaaacagttgcaaatcggggttgtatgcaagtcttcgattgtcgaacgtcgcttcgatagcgtcatacaaagcgtcgtcattcaaatttctcttcgtcaggagctgataacagtcaaagaaatctttcatgcgactgttgaggacatcacgatctatcatcgtatggaacttctcggcaataacggtttctaaagaatatgcctgtatattcacagaagggatatccggtaaaagcagaggaaagtctatagttgttggatgtggaatgacgacatcgccaaagccaatatctacagacatattataagctatggtatccatatggacagtaaaatagaatcttgtaccaaaatatttcttttcgactgtaatcggttctattttgatacttcctgcgtcaaaagataccccatcttcatggcatacgatacccaggatttcttggaatacacgagccaggaaatccctgccacgactgatcctgtccgccataaacccacatcaaccgtaggacgagcctcaagtccattcatggcataaagcaaagaaccgcctttcaacaagaatttgtccttgtaccggcttacagaagccctgtaaagcagtctctcgttgaagtatcttgccagaagataccatgtatttatagcctgtctcattcatgaggttgagcaagcgtgtctttacagactttccatagtttttccttcccattatcttattctattgcgatttcgaggtagtttttcaacgtgttaaacactcttaggcgcttggcgtaatcctgcaaacgggcgagattacggttcggctttttcagataagtacgtattacttccgcgcaaacgtccagaccgatcttgttccgatacttcaccgcatcacaaacacttcgttccatatcagtaatatgaactttatatcccgatatatccgcatccataatcccaaactccaagttctcttttttccaataataaagttctataggcagggcgtgtggaagcactactttccttttattggcaatggctatgcaaaaagcaggcgggactgtcgtagacagttgatgatatgtccaggcattgtataggcatacaacaccattcggtattatcctctccacatctatcatcgtgtttagcaatgcctcgggagcagcatataccccatgacgcaatcttatcaaatcgccacgttctttagctcgcaacacctgtttatattccgacaggtgagatatatccgttgtggatatagtccctccgagagacgcaactttattaactatatcattcatataatccaccttagaagttcttttcacactacaaaaatacgattattttccgaataacaggtaatattctacggttaattcgcaaaaacaccgtataatactaccagtatccgtttttcatatctatagaagaagccctgtgccatctgatgatttctgatgacatctgatgccattgcttttcatgtttcaaagaaaaagcggttctttgcccaaatccatgaaaatgagatgttatgaacatacaggaagcaaagaacatcagacttgttgattttttagccggattcggatatgaaccggtaatacagcgtagaaacagcgtgtggtacaaatcaccttttagggcggaaaagaaggcctctttcaaggtagaccttcataaggaactgtggtatgacttcggactggccatgagggttctgataatctcattccaatgcattacatgtattgcctattaatggtgctataattctgatatatgatgtcttgcgcatggatttgcctcaacgaatacgaatctgtcctccgattacttaccaatattccactgcttgaataatattatccccaattatagatgtccataattacttcttttatattagctgttgcgccacctgtaaattctcttttaatattttaccgagactttttgcaaagtgtttgtatgaattcttttctttctctttatcattatccgataaattactactatcaatttcagagtgtacaaaactgacaatactatcaattgcattatctacggttttgctgctaatttttgatttatatcccaatgcatttataacacatatatttaccagctccaatatctctggcgatttaatagctgcttttattcgctctgccattagttttgcacctttatcttgtgattctgacaagatgtcaagaaagatatcagctaatgttatttccctattctccataatcttcaaattacaaactttccagcagttctatcattttatagatggtagttgatggattattatatgtatccagcatcttggctcttgccgttgcttctgatgttttttcagacagttgctgtttctcatttaatgccaaagttccctttgtgtagtgttcaagatgtcttttcagtttcttgatgcagacgttttgcgttagttcggcatgacacttctcaaagtgcagcaaataccacaactcaatacatggattcgacaccatcaatatcgcatctggaatacttagcaggtgttccagcattccgtccacatctaggtcaaacattaggaatgttttatcatttttggttacaacatattcccgtttacaattctctatataccgaacggatatgttcgaatcgctctttcttgggataatttgaataggcgcacggtattgtgaacggaggtggctgatataagcaacctcagactccccttcacagaaaacaaagaagttcggcttcattgttttgcctttggattttcttatttgtcgtcccatatcagtttctattttagaaaattatccgtctgttcgtcaatatacgggatggcatcaaaacgaccttgcagatatgccttttcagcatccagcccgtcacggaaatctttgtaatcaaacagcgaatacaaatccgaggacccgtcatcccgtttgttgacaaaatatatctgatccttacgcaacttgttggtattaagcaggtatgtattgtgtgtagtatatatcaactgcgccgattcgcttttattgaacaaaccgataatatattctaccagttttatatgcagctgcgtttcgatttcatctatcaacaagattttattattcttgacgatatccaggattgtcagcatcatattgaataaacgctgtgttccatcagactcttctgcaaaaaagttgaaaggaacatccgggttatttctgtgataggtcgtaatgaccaactgtggtttctgaatatcttctaccgacaatatttgattgtctgcagggtcaatcactgctgtcgaaaatactttattctcgtgcctgctgtcgattttgacaatgtcgctatcagcaattcgcagcacattaaggaactgttctttgttctcattcaacaagcgctcgacagagaacgaattatatccgaaataattcagaataaaacgctcattgaaatatcgaaaaacatcttttgctgtatctcgatccatctgactggcgcgtgacacgaaaagcgtttttttggatgtattggcagcaacatccatagggcggcgaatcaccgagcggaattcatagatattctttttgtcgggtccctttgtttcatcacgggaaaataccagtgaacgacggccattcggataatagtaaagtgcctctttcagtatctcaactttattgagttcaaaagaatattcatattcgataccttcaaggaggaagcgaatgaagaatgtacttggcttgccaatgcctccgaatttgaacggagtaaaggcaaatatcgtattctcattgtaattatgagatgagaatatcattcccacacaagcgcgaatagccttgataaggctgctctttcctgacgcatttgcaccataaatggcaacagttttaagcaaccgctcatcaccgcatacaaatgtattttcttcaagctcctttgccttttttgtctgtatgcttgctgcctgcatatccagtaccacctcatctttaattgagaagaagttgctcaaacgaatttcaagtatcatttcatcccttaaatttgtaattgttttgcaaatatagcaaattaaatgacaaaatcataattcggacaatttttaatagattagaggtagcctgcataaagtattgttatatagggggcgttcgacaagccaaagaatgatgtttctatatctgtgtgttcattcactgcttgcaactcataaacctttttggctaacgcaatatgacacacttacagtggtttaactttatctgccagttgcatggttgatacgtatttatccgctatacagcccgattgccaataccccgactgacatttgtcatagggagcactgttcatacaagcagcaagttgaaacatgaaagattgtccgaaacgatacaaaaatagtatgttcaacgtcttgagaactgccgtcagactatcgcagaaattactagttattcgactcttttcatttggaactatttcgtttggataattctcttcaatttctcgttctattcttgataagactacctgtttgtgaatttgtcacaattggcaccatgttttttaatgaattcgcaaagattcttgtttttacaacaagcataggttatatatttatagtttatttttttatctggaagattgtatcctctaaaaaatgtgatattattctcaagttatcatcgaaaaagtgttgtatatatcggttttcatcctcgaaaaaatgtatctttgcaagagacaagtgaataattcttattttaaaggaatcgatgaaacggaagattatacaacagttgaaactttggaaagataatcctgcgagaaaacctttgatactgttgggtgctcgtcaggttggtaaaacttgggtgatgaaacattttggtcagacagagtttgagaatgtagcctacataaactgtgatgtcgagccactggccaaggagttatttgcagccgactatagcatcccccgtattttgctgacacttcaggctatcacaggaacaaagattgaagcaggaaaaacgttgattgtattcgatgagttgcaggaagtggaacggggattgcatagcttgaaatattttcaggaaaatgcgcctgaatatcatgtgatggcggctggctccttgttgggaattactttggggaaaggtcagtcctttccggtgggtaaggtaaatgtaatgcatctatatccgatggattttgaagaatttctgatggctgccggtgaaactgatttgtgcgatttgttgcatcagcccgattgggaaattttaaagattctcagtttaaaatatgttgatttgcttcgccaatactattatgtaggtggcatgcctgaagtggtggattgtttctttcagcatcaaaacttgcaggaagtacgtgacaaacagactgaaatcctggatgcttatcggcgggacatctccaagcatacgacagctactgaaagtatacgtatcggacaagtgctgcaatccttgccttcgcagttggccaaggagaacaagaaattcatctataatgtgttgaagaaaggagccagagctacggaatatgaactcgccattcagtggctgatggatgcaggtctggtacataaagtcagccggataaaagaactgcagatgcctgtcaaattttatgaagatctgggtgccttcaaattattcctgcttgattgcggtcttttaggttgtatgaccgaggcacccgccagccaaatgctggtaggagataatgtattcaaggagttcaagggcgcttttaccgaacagtttgtcttgcagcaattagtggcccaaggcttttcgccctattattggagcagtgacaaaacacctgcggagattgactttgtggtacagacggagcatcgcgtgataccggtggaagtgaaagccgaagagaatgtacgtgcgcgttccatgtcggaatatattaaaaaccatcccgattatcagttgaaaggattgcgcatctccatgatggggtatcaagatcaggaatggatggagaatattccgttatttgccattacgaagttctttggataaatggcactttcatggatatgagatacacatatgaagaactttggaagtcatgggtgtataaaaacaaaaagctcgccaaatccctattctcggatttggcgaactcattttttaggactcaatcgaaagggcactgaaaaagttcttatttttcagtgccctctcgaagtgaggattattttttctgtcaaccggtccaaaggaccgccttgcgcagccgggggcaaaaggtgccctttgcgggtaagaaataggaatacgacactagtggccacagacaggatcatctataatcaaaagcctccatcctgtttctttccaacagcacgaggatgtccttttccttgtacaataatttgcctcccactttgtaataaggcagtttacctgttatcctgtactcggccagtgttctccgtgtcagtttcaggtgttcggccagctcgctgtcggtcatataacgttcgccgttcagaaccggccgcatcttttccgcctgtgtgtccagtatttcggacaggctctcaatattccggaaaaagcgtatgatttccgggctttccttggtcagcatggattggatcatatcattcgatttagaggtgtcacacgatgaatttccgcctccataaagcggatgatatcctgccgtttgtaatatactttacggtctatgtaactgtaggggatggacccgcttctccggagttgtaacatttttcttggcgagacatccataagcgtacatgcctcctggttgtcgatccactcatccatgccccgcgtgcttcctccgcatgtctcatgtactcttctggcgatggcttccagggcctcgttcatttccatgaatgtcttggcctcgatacacacaaattccataagtctttccttttttcgatttgatacgaaagtatggagagggagactcatatccaaaaaggtgtccgcaaatgtcatcagatgtcatcagatgtcagatatacattggtttatgatatttttagcctgttccccggaaagataaggcatggcggtagcggatagccggtaatatgtaaagtttacaatccgtattttacagttttacactttacctgtttacacctgttacattcgaaaaggaagaaaaatacaatttatatctaattatcaatgtgttataattctgcttaaaagacataaaggaggtatggcatacatttttcataataaaatggtatatactcttacagtgcgcaccgggggtatttcagtagtaacctttaaaaaatacaggagatacatgccatgatgtatatagataatgaagtgctcgagaaaatgataatgaccatagtggaaggatttgaccgcatagagaagaaactggataggatgggccgtgtgaaggagttcttgaacggtgacgagcttctggacaactatgacatagccaggctgctcaacgtgtcgcttcggaccgtggcccgctaccgggaaaaaggactgatccgttattaccagacggatgagaacggcaagaatttctacaggagttcggatatacaggattttttgcagaaacggggaaagaaaaactgaacggggcaatgtggatatgcggaagttatgctaactttgtcttataaacggttgttatgaagacaaataccaattcaaaatatctcattgcggttctgattgacggtgacaacgtgtcctttgagaggatggaggatatcatgggctttgtttcccgttatggggatgccgttatcagacggatatacggtgactggacgaggaaagctctttccggatggaaggagaccgcccgggaatatgggttcaggttggtgcaggcctcctcctatgcttcaggaaagaacactacggatatcgcgttggtcatagacgccatggacattctccgtgacggccgggtggactgtttctgtctggtcgccagtgacggtgactacaacccgttggcgcaacggatacgggaggcgggattgaaggtactgggatatggggagggcaagactcccgtatcgctgatacgttcctgttccgtattcctgtatgccgaccgtaaggaaaacaagaccttggagaacactccggatttttttatccgaagggatatggagttttttgacaaggctttccagcaggcggctgacggcaaggaggaggtctccctttccctgataggcggctcgttgaagaaaatgatgcccaaattcaaggtcaagagatacggatgcaagacattgggcaagctctatgaaaggttggaacggtacgagctggtcatgacggaaaagggagtggcgagtgccgtacggatgaaaggtcgggccgtacggcaggaatgaccgggaataaatccacgtccgtttataccggaatgggatttacccgtagcgtgtcaaggttgagataggccccccggtagaatgtcctcccttctctgaacatgcgccagaggatgtcgcaaccgatttgtgccagcatggagttgatgaacagatcctgcttgcgcaacgcctccgtgagtgagcaactcgggcctgagtcctcctcccggatggtggagtagctgacctcctcggtgatgacattcatcctgggcatgggaaggtattcgctggatgcgggctggcttattttgctccggatattgcctaccaggacttgcccggtggtttgggcgttcccgaaatccatccagtatatcggcgctttctcatcgttatttttatattccctgtatttcttcaggaaccgccacagatcgagccgggaacgggtgttgtccgtacaggtgatgatgatgttcgccagcgggacgcttttatccccttctttggttatgatcggatagcggcattccctggcctcccacgcgtaaccgaaaaaacggttgacgcgggtgacaagcgccgtcgccttgttcaaccccagttccgtctcgctgaacagttggcggccgatgtttgcttccgtgacagtgtcggggtcgaaagccgtcaggtgcagccccggatgtcccagagcctgtaatgccacgctcatgcgtgccaggttggttattacctgcgagccggttccacccgccccggctaccaggacggttacggggtgatagggactgagcaggtacttgtctgtgaaatggatctttctcatggcaggatgtctttcaatcgtttgttgatcggttggagttcgtcgttgtcgaacggctgttcacgcatccgctcagtaaccaggaccagattgtttcttgtcgggttcttccctcctccaagatgggaaaattcactgagccagaaacgtttctcccaatattccaacagggtgtgaaaatccaggctctccggtttctccagtgtggagtttcccaggcatacgtttccaccggtcacgttgaaaaaaggggccagatagagcggtgtcctcccgtccggttttttccccttgtaggcgaagatgtccatcctttcatttttaatgatataaatgactcccggcacgtggaacattccatccccgatgttcaggtcgttcttgaaaaacatccgccgttttcccggcggattataccacacatagctttcatgccccctgcgggtatcgcaccacagcatgttgggtggcagccacccgtgcgggatacgccggttcccgtccgaataggattccaccagggagtccatgaattcatatgtaaccggaatgccggcttccattcttccctttttgttgatagggcgtatttccaggtagtgacttccgcttgcgtagtgaccttcctggtactcataggcgatcagcgccgctttgggcaccattatctcttgcagttgcttggtaagttcgttcatatcctgtattttttttgttttcgtttctttatttattgggaaacgggcactttaaaatgccagtttatgcattgcgtgaatcgttccatccatccggacagtctctccggatagtcgtccatccggaacagtctgtccgtctcaggtgtcaggtacatgcttgtgatcggggtgatggcatacgtctcccggtagtccgagttgaaatagcattccatgttctccgtaagggtgtcattgttggaatatgccagcatgatctgacagtccaggtcgatcggggggaaatccggtgatctttcatacgcccaatcgtaaccgtattgcatgatgcacggatttcctggggtaatcagtcccatcccttcccgtatcagttccaaaagctcccgttcctccttcactgccgcccggtatttccggaccttttcttccagatcggtacagaacggtttcccttccattcgtttaagtgtttttgcgattttcccggattggtaggattccgccaggcgtttgtatttacggattgtctgaggggaagcctcgggatcgcggttcttccagtcatccagttcctccaccgccagctcataataccatgtttccgtgacggcgttcaacccgtggtaacgtacgaactgccgtatgaattcccggacgatacgccgtaacggtacaggaaggttctccgtgaaatcgacgggtagccagaacagggtatggtccggccagtcatggaacctgtacaggcagaaatggagcctcccggccctttcctccagattgacatgttccggcaaggtctcgtccagggccttgtataaggcggtgatgttgatgcggggaccgctccctttcctcgcgcggaaagggagcctgacattcatgagatcggcatatcgcagggcggaccggtatagatagtcaaagttttcggacgtggtcaggttgacgcatgcccctcccgtttcgtcctccaccagatagtccgccgcgatggggaggaatctgcctgtcaaaaaagcgttacgctccccggtggcggcagtcttcttttttcccggcccatcgtaccccgtccgatgtacgagaggtcggcggccctgatgatcaatacggccagtcccgccatttgtgattctgatagcgttttgcatgtatcctccttttttttgatggaaattctctttgccatatatctacccttttgttccgatggtcgtcttgaaccggtagaccacgctgtcatcctcgcattccggaccgtgtacgctcgccgtggtcagttccggataggtcatggaatagaaatccatcacctcgttcggggacaggctgttgtccggatcggccagctctatttccgacgagcctttcctgattttgaaaactctctgcaatcctttaatttctagtgccataattgtatttttatagggtttaacaacatatcatttccatttgtgcctcgtctttcatgcggtattcctccgggaagtcgagatattccgcgtaagggtcctcacgcaggagctccctgtcatgctcgtcgtccttgtcgaagccgtactgtcccatgtcctgcgctcgtgccccgtattcgctttcccctttgttatcgggaacggtttgcgtggaagccgtttgcggttgcgaagggacgggttgcagccattgaccgtcgtatacctgtgattgcggcatctgtaccggctggtggaattgtatggtctgcggtcggttcacgggctgctgacagccggccggtgtaccatccgctcctggtcgtgaagccgcctgtccgtgtggaacctgttgtggtcgcgtgccttgtaccgaccgcggaatctggtggggagattggcgggacggttgttcgggtgcgaacatccgtatctgttcccctccctgatatcggggggcatgaccgggtaccggttgcggcgccaccggttggataacctgcgcgggctgtggttccggcattaccggttccgctccgaagagactgccctcggacgcttttttctgtacctccgctatcttcacgtcaatctccttctgcttgtccggcatggccagccgttttgcctgtctgagccaggtcaacgcctcggaatagcgtttgccgcctgtggcgtcctccgcctttttaagcagcttttccatcttctcccgtttctcgcgtacctcttttgattccttctcagctacggacttggccgccttgctttgtgatacggcctgttccgcttgtttctcgaatgtttccaggttggtaaggatgccctgcgccttctgtacgggcgcggtgatcgctcccaggaattccatgtccagctcttccggggtaccgttcaataccagcgggacgatttgttccccggcctcgtctttcagtcccgcacgccggggcatgacggccacggtcagtttgtcattcacttgtctgatgttgatactcaggtctgtgcctgccgtaatcattcggttgatcgtttgaaaaaacataatggtaaaatatttgtaagttatacataagtttcttggaaaaactctttcaggagtctctgcctgtcgggattggacgcgatgtcctttaatggctccaggtagtggcctattgttttcggttcgtccaatatgcaggggaaccgttttttgacaggttttatgcgctttgtgacgggccatgcgaccggcatgaccggggctgagggggtggatgtcgcggttctcatgttttttgtattttaggagttatgcaagcatgcccatgacggacaggataaggatgacttttatcacaaggaggaatgccctgaagaggaatcctatgattgttcccgataaaaggaacaggacgatcaggtacacgggaatgattcccttgctgtagagcaggcatattcccgtaagcaggaccagtgagaccactcgcttgcagatgttttcgataagttgtagtttcatgtctttaaatttttaagaatgaataatcccatcgggatatgttttcccgattttataggcctccggcccttggattgcctttttgcgcaaggcttggcaaaagaaaataccgcagcgaagcgaggatgattttcttttagccaaccagcccctgaaaggggccgccttgcgcaatcaacccggcaaagggctatatttgcaggtaagaaattgaaagaatggctgggattttcaatttgtcggatacaacatgtaataagtgtaatgagcaaatttaaaagcatacaacgaaggtttttcaaatattttccaaactatcggatatcaatatcatatcgtaaaacaagcgaaggcgtggcattccggaataaatacatgtcttcgcgtcaaaggtgattgattgaaatgaatatattctctgcttttgatacgggtgtcatggtagctctcttgctgggtattgagtttcttaggagtgatatccaaacaattctctattgtaaaagaaacgatcccgggatttttaagagctgcctgtatacattatttatattgttggcaagtctttattccattgtggccggagccatgcttaaccccgagcccgtacccgtttatgaattgatgcccggttttcaaataggagtttatggttcttgttttttgtttatatttcttgttatcgccggtctttaccgtaaaatattacctctcgtccttttggggtacgctatggtatatgtaatcggtgtactgataccgttacttggatatgtagtgtccatgatgaattatttcgccagcgtaggatgattatgaagatcaaagatgttttccagagaaaatggataacagacagtataacaaaaagaaggtatccttttcagataccttcaatgacgggccggttgcatatttaccctaatttccgcaagcgaatgaaatcagagattgccatgcattttttagtgagtttattatctttacattgtgttttagtgaaacgaaggtgccaaaggtccactcttttgcataacttccccttaccccatgaagcgacttgaggcaatacgcattacccaccattagaataaggattagccaaaatcctgttgaaaggctattttatacgctggattctcggtatagatgtttagcacgtacgtccttgaagtcctaatccactttgcggcaatcgagatgtatttgaaaatattggtgtccggtaaaagtttgaccgaatcaaaaatacaaggctgaatcccctctcggaggtccagcctttttcgttacctttgtttctgctaaaaaataaatcaataacgatgaacaaaggtagtcatttcaacggacagccggcatatggtcagctgataaatttgctggacaagtcaaaaattctccaaatcagtcaagaaaagggcggcgaacggtatgtcaaacactttgacgcttggcagcatctgctgataatgttgtatgccgtgatcaaacggttcgattcgctgcgggaaatcacggactcgatgttccctgaagcgagaaagcttgcccatcttgggataagcatgatgccccggcgcagtactctgtctgacgcaaatgcacgcaggtcagagggaatctttgaggcaatctatcgcgacctgtacaagacataccgcaacgaactttcatcggacagccgaaacaatccatcttccagttggataaaccggctgcagattatcgattcgacgacaatcagcctgttctccaaccttatcttcacgggagtcggacgccatccgaagacggggaagaagaaaggcggcataaaggtccacaccaatatccatgcaaacgagggagtttcttcagatatcaggttcacatctgccgccactaatgacagtttcatgctcaagccgtcaaattacacaagcggagacatcgttgccctggacagggcctacatcgattacgccaagttcgaggagctgagccgggcaggtgtcatatatgtcaccaagatgaagaagaatcttgtctatgaggtttctgctgatacgatatacatgacagaaagtgggttgatggcacttcgggaacgccatgtgacattcacgaagaaggtcaaagatggcgacgatataaagcaccatgcacgcatagtcacctacgtcgaccaaaagaaaagaggggccaagctcatatccctcctcacaaacgacatggagatgagcgccgaggatattgtggcaatctaccggaaacgctgggagatagagctgttgttcaagcagataaagcagaacttcccccttcggtacttttacggcgaaagcgccaatgccatcaaaatccagatatggataaccctcatcgccaaccttctactgatggtgctgaagaaacgcatcaaacgcagctggagcttctcgggattggcaacaatggtcagaatcatgttaatgtattacgtcaacctctacaccttcctcgaagaacccgacaaagactggtcaaaactggtagccgaggcagaatcgccacccaaggaactcctgctctttggatagaggggcttaccagacaaaacaaacacccgcaatgcctatcaagtgacactgcgggtaggcgaatcgtactacactaaactttagcggacagcaatgatttgaaaacgaaagtcttaatacgactcgatatggataggccaaaatccttaacgtttaattttcggatgattgttttgtagaagttccttatcaatgcagtcatcagcaggtatactgcattttctgccatgaatgactttggcaaatgtttccatccaaacccgttgttcatgtcatcgaggattctttccttcccaccgcacaggttatagaactctacgacatcccttatgtcggattcgaaatcattggtaaggatacaccggtaggtatattctccttcccatagctcccgtatgtcatctgttcttctttgtctttggatgacaagacggtatggtttccccttccacttttctacgacaatcgaattcagctcgaacctgattccgttgatctcctcagccttccatcccctgagggcgaacatgtcatcgtaaaaagcggagcatctgttggctctgatatagaagtacttgcaatgggccttgacggtatctacaatctcttcggagcacgacccacaatccatacgagctctatttatatgaatgccgttacattccagcctggtgaagattctttccaatgtacactgctggcagaaccggacattcgtgttgccatcccgattttcaatgccgacaatatggtcacctataacggccactcccgggctgtatcctgtgaacttcttgtatgtacgtttggcatcatacttctccgtttcaatgaactggtggtcaaaatccagatcgtaaccctgctcctgacataattctccggtagcaatgagagacttgaccaacaattcgttcattgtgtcagctgtattgaagtcatatgatttacctgagtctggagatgaatacgttatgttgtctgtagtcagttcttttatggcgcgaagaatcgtgtctgcgctgcaggttttaagtttgggatgcagggaaagatggggcatgagatgagtggatatgtcttcaatgcacgagccgccacagaagaatacgcacatgagagaacggatgatttcactgtattggtaaccataggttctgctacgcagtcctaatgtggagtcgattacgtccgataaaagagcatcaaattgctccatgattgaaaatattccgccaaaaggtgtgattgaatcgaattttatttgtactttagccatgtctgctgaagattggtttgatttttattgcaacacgaagttaagtgaatcttctgacatgacaaagcactgggtaatacattactactcagtgctttaaattattcttgtacaaaagtgttgcggaaattaggtatatcaacaattgaggaagcgttatgcttgttttgttgtgactccactcaaaatgcggtgttccggtttcacgcttccatgtattatcaggttcttccaagaaacctggaaggcgtaaaataatccacatttatgaagcagtattggtcttttttcaaatcgggcaagtttgcttttcttgccttgttcttcgtatcacttacggtaatatcttgtgacaacgatgacgataacaatgtttctcccgatccgcctattgagaaaggcgaaattgagcttgcagaaaatgcccaagctctcaactattttgattttatcaatccgaacgatgtggagatcttaaatgctgacacaacacagattcgtgtgagccaggcatacctggataagataaagacaaaggtaaacaagaacgatgtgttgtctatatggcgcagcattgacacgccacctttcattcggaaggtatcaaatgtatcggcaaacggaaaggatgctattctgacgacaacccaaggtacattggcagacctgatagagcatggcgacttcaagctgagcacggaattgtatgttaactacggcgagaaaggcttgaagaaccgttattccaaagacggcgtttatcatcccagcgtggttatcttcagcggtacagaagacaatggcaaaaagtatgcaacagccgaagagctgctggcccaagaagctacatggcatattttcaacaaggatggaataaccaattattcatacgaagaaaaaggcttacgcattggactgaaggatgtacagacccacacagcattagaccttgaaatcggcatcaacatttcctggttcaaattacgtaactttgattgctacttcacaggtgagtacaaactggatggtcctctgttcgttgaatgggatgtgaaggataaatcaagcggcggtgaagtcccattagtctattatcctcctattgtagttgtattcccgatagcaggtcccattcacatttcggtcatggttatacccactttaactatggactgtaatgcacatgcaaaaggcacgataggcataactctgcccatgacttttgattcttcctttaagctgggtccttcctatgcaagagacagaggctgggtcttttataaagaatacaaccattcgtttaactgctatgtagatcgaaccaacatcacttactctggtgaagtggctgcaagcctgggtgtatatttcaagacggaagtcaatatagcctattgcggaggtcctttcgttaaagtaggtccttctgtttcaacagatctgtctgcaagtgtagtaacgggttccgactatcagttcaaggtcaacaccagcggcaagtttaagctggccggtaagacaggagccgaattgcatatagtgggatattcgttaggcaagtgggaaacggaatatgttttagcggagaaagatgcctggaataaagaatttatagtagatatgtggcctaagtagggcttttagcggataaacctcaatcagtcattagaacgagaaaagtaaagcgactgactatttttattcgttctaacgaccgaattgggttaaaagagacaaaatgggcgaggaagaccactgagctttcagcctattttgtgactttcacttatagtctaaaacgatatagcattaatgaattgtcttcctcgtccatattgggtatgatatacgaataataatagggtgccatatatcccattactctaaaattcgtaggaacggatacatctgcaatgagcttaccttctttataaatttgcagcccatctttttctatatccttctttttatacgatctgaataaagattgattgctgattacgtgtgttgaaaatagtttaggatatcttttgtccgcctgactactctaatgctatccactttctatccacccttatttttgtgacagactgttggctggatgctcgtggaaaatcgttacttttgcagccgttttcaggcaggataggttcatgtaattgggataaagtggcattagccgtaggaattcctgcatcagaaagtgattattatcaacataaacctaatttccgcaacacttttgtataagaataatttaaagcagtgagtagtaatatattactcagtgctttgtcatgttcgaagatttacttaacttcgtgttgcgtaaaaatcaaaccaatcttcagcagacatggctaaagtacaaataaaattcgattcaatcacaccttttggcggaatattttcaatcatggagcaatttgatgctcttttatcggacgtaatcgactccacattaggactgcgtagcagaacctatggttaccaatacagtgaaatcatccgttctctcatgtgcgtattcttctgtggcggctcgtgcattgaagacatatccactcatctcatgccccatctttccctgcatcccaaacttaaaacctgcagcgcagacacgattcttcgcgccataaaagaactgactacagacaacataacgtattcatctccagactcaggtaaatcatatgacttcaatacagctgacacaatgaccgaattgttggtcaagtctctcattgctaccggagaattatgtcaggagcagggttacgatctggattttgaccaccagttcattgaaacggagaagtatgatgccaaacgtacatacaagaagttcacaggatacagcccgggagtggccgttataggtgaccatattgtcggcattgaaaatcgggatggcaacacgaatgtccggttctgtcagcagtgtacattggaaagaatcttcaccaggctggaatggaacggcattcatataaatagagcccgtatggattgtgggtcgtgctccgaagagattgtagataccgtcaaggcccattgcaagtacttctatatcagagccaacagatgctccgctttttatgaagacatgttcgctctcaggggatggaaagctgaggaaatcaacgggatcaggtttgagttgaactcgattgtcgtagaaaaatggaaggggaaaccataccgtcttgtcatccaaagacaaagaagagcagatgacatacgggagctatgggaaggagaatatacctaccggtgtatccttaccaatgatttcgaatccgatataagggatgtcgtagagttctataacctgcgcggtgggaaggaaagaatcctcgatgacatgaacaacgggtttggatggaaacatttgccaaagtcattcatggcagaaaatgcagtatacctgctgatgactgcattgataaggaacttctacaaaacgatcatccgaaaattaaacgttaaggattttggcctatccatatcgagtcgtattaagactttcgttttcaaatacatctcggttgccgcaaagtggattaggacttcaaggacgtacgtgctaaacatctataccgagaatccagcgtataaaatagcctttcaacaggattttggctaatccttattctaatggtgggtaatgcgtattgcctcaagtcgcttcatggggtaaggggaagttatgcaaaagagtggacctttggcaccttcgtttcactaaaacacaatgtaaagataataaactcactaaaaaatgcatggcaatctctgatttcattcgcttgcggaaattaggtttaccattccagacgttccttcacattgttcatcgcctctttcaggctgctgttcatgacccgcgcataatgctgcgtcatgcgtgtggaggcatgtccgagcatgacggacacgtcctgcaagggtacattgttggcgagcgtgacggtggtcccgaaagtgtgcctggccacatgcgtggtcagatttttctttatgccgcagaaatcggcgatttccttgaggtagctgttcattttctggttgcacatgacaggcaggcagcatcctttctttacgcagatcggatgttccctgtatttctccaatatggccagtggaacgggcagcagcgggatgttgctgatggaagacgcttttctgcggtgttccaacttgacccttcccttccttatccaccagtcaccgagattgtcctgtaccaggttttcaccactcagagtggcgacatcggagaacgccagaccggtgaagcacgcgaagacaaatatgtccctgaccagctcgagccgtgggatggtgaatttctttttcatgacggcctgcaactcgtcgtaggtcaggaataccggatcggtctcgtcctgttccatcttgtaaccgtaaaagggattcttacgcatccattcctttgccaatgccatgttggtgaatttcttgaaacatttcatgtagcggactatcgtgttacggcacagtcccccctccgttttcaggtaaatgtcaaacgcgcggatgaactccggtgtcagctcatggaaggtgatatcctccttgccgtaataagaggggataagccgctgcaatttcttcaccacgttcttgtaccggttgatcgtaacgggagagtagtctatgcctgtcagtgtttccatttccttgatgccatcctgcatggtaccgagcaatgtacgcatttcggtgtctttcccgaaaacacgtttcaggatcagtttcggggtaatcagggcctgttccaataccagttccttgtgtttctcgagggcacgtgcgtgtaactccgcaatataggtattcaatgcgatggatgccctgtccctgcccttgctgcatcctttggccgcattccataagttcagaggcacgcttctttggatacgggcatcgtcgtagctcccgttgatggttatccgcatcagtacgggggcctcaccgtttttcaacaatttcgttttgagcacgaaaaaaagaatgttcattgttccttgtttcatcacttttgtttttttagaggtgttacatccaattgtttcgtcaaaaccggatggcatgaggacgtgaaacgaaatgttaaattcggtggcttttttgagggacttgtggaatagccataaaaatcccatttttatcaggttcgaattgccttttgtatcccgggttcgattcctttttttatcccgatgggaaataccgaatttttaaatttatttcacattttcaactccatccggtcatgtgtgcaaaattactttttcacaccggagattgaaattgtcaaacagttgaaaaacaatgaagtatgatacatatttatggctttttcaaaagccttaaaaaaagccactgaactggcaaaatccaacttcacaaatatgtaatgaaatgcgtagcgagggtaaaaaaagaacccttgaactatctctaattcaagggttttctaaaattgaaaagctttttggtggtgccaccaggaatcgaaccggggacacaaggattttcagtcctttgctctaccaactgagctatggcaccatcatgtcgttttgtatatcgttgtttcgattacgggtgcaaaggtaggtattatttttaatccagcaaatgttttgaaagaaaaattcacaggacagtaaattatctatttttcctgcaaaaaaatccacttttctcttgcaggttcaaaaacaatgtgtacctttgcacccgtaatcgagacaacgatacaaaaaaacgggatgtagcacagttggctagcgcgccacgttcgggacgtggaggtcggaagttcgagtcttctcatcccgactcatcaaaaaggcaagaatcttgaaagagatcttgcctttcttttttcaatcctattaatatctaatgaataacaaaaggtatcaacatatattgttcgatctggacggtacattaaccgatcctatgattggtattaccagttctgtaaagtacgccctctcctatttcaatatagaagtagaagatttacgatctttatgccctttcatcgggccaccattaaaaacatcctttaaggacttctatcagtttacagatgagcaagcagatgtagccattgctaaataccgggaatatttttcaaaacaaggtattttcgagaataccctgtatcaaggtactgatgaattactccgtttgcttaccgaaaacgaaatgaaaatctacttagccacctcaaaaccgcagcccttcgctcaacaaattctagaatatttccacttagaatcttattttacatttgttggaggaagcacattcgacggaagccgttccgaaaaagcggatgtaatacaatatgtattagacagcaccgatataaaacacggtctgacgtagtcatgatcggtgatcgtaaatatgatatagaaggggccaaagcgaataacatagattcaataggagtcctttacggctacggggatgaagaagaactagcgaatgccggagcaaacaaaatcgttactgatataaaagaactatcatctttccttctaacagggaatatccccatatagaaagcttaagcagatctataaatcacattaaaaataaacatcagcaataaagagaatgaaatatttggaaagctcggcttcaaccgggctaccaatttttctatagcgatcttcatctgtacacgaaccgtactctcttgaaccgataatatttccgcgatctccttcgttttcaatccctcctcacgagacatcaaaaacacaagacggcatttctcaggaagttcgtcaatcgctttatcaagcatctctctcatctcttttaactccaaatgctcctccggagaaccctcatcttcctcttccattaatggcaacaactcatttaaagaaaccctattcaagtctttattccttgcttgaaaacgaaaagactcgttacgtacggaaatatataaataggtatctatattatcaatatcctttaatcgtttccgggattgccagaccgagaaaaaaacatctgtcacaacttcacggcatgcctccttctcgcctaaacaataataagcgaagcgaaaaacctgatcataatataaattataaaaacgttcgaaagctcccctgttatctaccgacacagattcaagcaaccctttgatatctcgcacaaaaactcccactcctttttctttgatttggcaaacatactaaatataatctaaatgcctttttaaaaagcagactattttttctcatattttacttgcatattcaaattattaaactacttttgcacccgcaatacggaagtagctcagtcggtagagcactggtctccaaaaccaggtgtcgggagttcgagcctctccttccgtgcatgagcggcaacactatgaatatgtgttgccgcttttttattattctccttctcttcccattgcgataaaaaagcgtaaataagacaacatttttcgttaaagagactattttttctttcaatatataaaggaatatactacttttattgccgattttaaatctaattgagacttagtgtaaatcgtataccatagaaacagatgacaactaacaaattttcaaatcgatactcgtctgagaggaaaaagtattttttcaaaagtaaggcgtttatcctgtgcctcggattatttttgggagctgggattatgatcgccctttataaaacatctgtatatttctcgacagatgaatcttgtatgatgtgccacgtgcatcctcacgtagaaaacagttggaaactttccaagcatgtaaataatggaagtggcgttaagacacattgcgtagcttgtcacctcccaccccaaacaaatacttggaaacattatagcgcaaaggctaaattgggtatgaaagatgtttggtcatacttgactaaagacagcgcggatttcaattgggaaactaagtccgagttggaacacgccgttaaatatatccccaatgaatcttgtaaggagtgccatcagaacttattccccgaaggaattaccgatgatggtgtaacggcacatttatattatgatgagaatgagaaaaagctagatctacaatgtattagttgccatttggatgcaggacattacaatccgaactacaatcactccaagatggttggtataccaggacaaaatacatccggggcatcttcggataccagtttgttttttaaggaaccaactacagttacctctttcaccgactatgtagaacaaattcccggaacaatggtctcattcaagatgattgctatccccggaggttcattcaaaatgggtagtgaggaaaaagaggcatttcataaagcagatgagtcgcctgtacacaacgtaactgtcagtccgtttttcatggctgaggtcgaggtgacttgggatcaatactgggctttctatgggaatacgatgagtgagggccgtacccctccagagaccgtatacgcaaataacagtaatccgaatgtcgatgccatctccggtcctacacctccgttcggttttccggatcaaggctggggtggtggagatcgcccggctattacaatgactcattatgcggccgagactttctgccaatggttatccaagaaaacaggaaagacttatcgtttaccgaccgaggcggaatgggaatatgcggcacgtggcggcacggaaacgccttatttctttacgggcaatccaaaagatttctccgatcaaggcttctggcgtaaatttttcgacgcaaagactgatagtataggttcttatgtgatttatagcaagaacagcaaaaacaagacgcaagaaccggatttagtaaaagccaatccctttggtttaaagaatatgttgggtaatgtaatggaatattgtgccgacaagtatgatcctgaagcttacgctaaaagcggaagtagcgccacagatccattggttaccgaaggtactgagtgggtagtgagaggcggtaattacacctccgatgcggcagatcttcgctgcgcttcccgtgattataccaaacatgaagcttggttaaaaaccgatccgcaacaaccgaagagtatctggtggtactccgatatcagaggaatcggtttccgtgttgtatgtgaacctaataaatagtgtctaaaaaataatatcatgaaaaaagagaacagcattagcagaagatcatttctgaaaagttcagccctagcgggtgcgcttggagcaattggaacaggtagtacagttggtgtattaacttcttgtggtggaggtgaaagtgcgaacgcaataaagcctttgaaagaacccggtacttattacgtgcccgaattaccagatctggcgactgatggaaaagaactaaaagctggtgtaatcggttgtggcggacgtggttccggagccgcttttaacttcttgaacgctgcgaacggcgttacgatcgtggctttaggcgatacgttccaagaacgtgtcgatgatttggcaaagaaattaaaagatgagaaaggaattgatgtaccggctgataaacgtttcgtcggcttggatgcatacaaacaagtgattgatagcggtgtagatgtagtgatcgtcgccactcctcccgtattccgtccagttcatttccaatacgccacagaaaagggcaaacattccttcttagagaaacctatctgtgttgatccggttggttaccgtaccattatggctaccgcaaaacaagctgcggcaaagaacttatgtgtcgtaaccggtactcaacgccatcaccaacgcagttatgtcgagtcttacaagaagatcatggaaggattgatcggtgagatcacgggcggtacggtttactggaatcagaatatgctttggtatcgggatcgtcaaccgggatggaacgattgcgaatatatgatcaaagactgggtaaactggaaatggctttccggcgaccatatcgtagagcaacacgtacataatatagatgtattcacttggttcagcggattgaaaccagtcaaggctgtaggtttcggttctcgccaccgtcgtatcactggcgaccaatatgataacttcagcgttgatttcacaatggaaaatggtatccatatgcatagtatgtgccgccagatagatggttgtgcaaataatgtaagcgaattcatccaaggaaccaagggatcatggagcagtgacacgatggagatcaaggatttggcaggaaacgttatctggaaatatgatagtgaggccgaaaaagcgaacttcaagcaaactgacccgtatacattagagcatgtaaactggatcaactgcatccgtggtggtaaacaaatcgagcaagcttctgagactgctatctccaatatggccgcaatcatgggtcgtgagtccgcttacacgggtgccgagaccacttgggatgccatgactgcctcagcattggattacactccgaaagatttgaacttaggaaagatggatatgagcggcttcgtcgttcctgttccgggtaaaccaatcgacaagaaataatccagactgtttatgacattaaatagaagaaactttttaagaacctccttatccggcgctgctttagcggtaggaagtacggccttggcctcctgctcttccaagtcggcaaacactgccaaaggagaaaaagggagcgacaagcccggcaaggaccttgaattaaagctttctttccaagagggaatcgccccgggtgaaagtttgaacgagaaacttgattttatggagaagttgggcgttgtaggttttgagccgggtggcggaggattagccggccgggtaaacgagatcaagcaggccttaaacggacgtaatatcaaagtgagtgccatttgcgccggcttcaaaggctttattctttctaccgatccagccatccgcaaggaatgcatggacacgatgaaagagatcatcgccgcagccggtgaattaggttctacgggcgtgattatcgttcctgcctttaatggtcaagtccccgccttgcctcatacgatggagacacgggatttcctttgcgagcaattcaacgagatgggaactttcgccgcccagcatgggactagcgtcatctttgaacctttgaaccgaaaagagtgtttttatctacgtcaagtagccgacgccgcctctttatgccgggatatcaataatccgggtgtacgttgcatgggcgacttctggcatatgacatgggaagagacctctgatatgggagcctttatctccggtggagagtatctccaacacgtacacgtggccagccgcaaacgtcgcagcatgccgggtgaggatggagatgccgataactatatcaatggcttcaagggactgaaaatgattggttataacaactacgtaagtttcgagtgcggatgtcagggagaccgtaacgtggtagtccccgccgccgtcaagttattacgtgaacaatgggaacaagcttgataagatgcctttagtatatccaaatatgcaattgagtgaggtggtggaagaacacccctcactcattcccgtaatcaaccggtttgggattcgtctcgggcttggcgacaaatcggtgaagacgctctgtgaagaacattcgctggatatggactttttactgacagtgatcaataccttcctcaacgaggagtattttccggagaagaagttacaaaccttccatacatcgcaaatcattgattacctgacaaagacgaaccaatactatttacgttatcagcttcccaatatagaacgccatctaggttcctttatctcgatgagtacgcccggtaatcctactcttggattgataggacgcttcttctcctcgttcaaggaagaactcatcgcccgcattgagaaagatgataagatatggttcccctactgcatgtcgttaagtaaaaagctgggaaaagaaccggcgggaacgatcgatggattgcaaatcacctccgagcaacgtacggaagataccatcgaggcccttttagccgacttaaaaagtatcatggtcaagcatctttcgggagattacgacgagaatttatgttatgccgtcctcttctccatctgtagtctggagaaagatatcaaacaacacaaccggatccggtatcgaatccttacccccatggtctcggccatggaaaaattatgtatctaacgatctgaaatgcatcgaaacaaacaaatagcgatcatactgtctgataccctaagaagtattgggctgcaaagcttgctgaccgactacttccccccggtagaggtttgctattttccaaatttcgagatgctttcctccacaggaagcgacacctacgattactatttcaccgattcagatatccttgtgctcaacgcagatttcttcctcccgagaaggaacaagaccgccatcctcatcgacagcaccgaagaacacggggcgctctcgtctatgaaccgtatcacgttacgttcctcccaagagaccattatcgagcaattgcaacaattatttacgagcgacagctccggcaacaccactaccgaaaacaacaaggacctatccagccgtgaggtagacgtacttcaactgatcgtaaaaggcatcacgaataaagagatcgccgataagctgaacatcagcttgaacaccgtcctcacccatcgtaagaacatcaccgccaagctgggcatcaagaccgtttccggcctcaccttctacgccatcatgaacgggatcatctcaggtgacgatatcgaactatagcgaagccaacaaaccagctttcaaaatcactacatctagtgattgaccatcctgtttctttaccgtttcttcgcgattgaaaaaatatactaacaaaagaaattcgatgaagagacactacttaggtatcatcgccctaggtgcgttggggctgcaaaatgtatacgccgagaatatcaaggctaacgagaacgacacgataaaaacctataacatgggtgaggtaatcgtgacctcatccacgaaggagacaaataacctccgcacgttacccggttccgtatcgatcctttccccgcaaatgatctccggcaggcagatcgacgcattaaaggatataagttctttcgtcccgaacctatacatgccggattatggggcaaaactaacctcggccatctatatccgcggtatcggagccagaagtagcggacaatccgtaggcttatatgtagacaacgtgccttatctggataaaagcaccttcgatttcgagctgaccgatatccagcgcatcgaggtattacgagggccgcaaggaaccttgtatggtcgtaacgccatggggggcatcgtaaatatctataccatctccccgttcgattaccaaggaaagaaactctccctatcggccggaagctacgggcaatataaagtcaaggcctcccattatgctaagttgagcgagaccatcggatttaccgccgccgcttactatgaccatagcgacggcttctacaccaatgcctacgatgggaaaaagatcgataaggaagacaacgttggcggtcgcttcaagttggaaggtcgcttcaatccgaacttccgtgcctcctactccctttccgtagattatacggatcaaggagcgtttccatatggcatgttcatcggaaccggaaataccgatcacaagtatgtaaatcctatcaatatcaacgatcccagctcttataaacggacggtcatcgccaataacctgtccctcgaataccggaatgagcacgtgatactgagcagcatcaccggtcatcaatatttcaaggatgacatgaagatggatcaagacttctcccctctctcgatctttaccctcaaccaaaagcaaaagcaaaacgctttcagcgaggaattggcgatcaagagcaacacgaggaataattaccaatggtccttcggactctacggtttctacgatgatctacatacggacggtccggtcgatttcaaggaagacggaattaagaccgttctccagcccgtattcgatcaattgaagaaagatcaccctaagatgccctatctaaaaatactggacgatcatctttatattccgggttctttcgacaccccttcttatggccttgctttgtatcaccaatccacttataacaatctgttcacggaaggcctgtcaattaccgccggtatccgcttggattacgagaagcaaaagatggattacaattctgaggctaagatgagaatggggttcggcttcgtagaaaacggaccggttatcgacatcgagaaacttttcccgatcccaaccaccgtgatggacgccagtgtctcccaagacttctggcaagtacttccgaaaatatctttaaagtacgaatgctcgccaaacacgttcacctatgtatcggtagcgaaaggttataagaccgggggctacaacgtacaaatgtcggcagacgtgatgcaaagccagatgcaatacgatatgatgaacgctttcaaggacatgatgccgatcgaggtcaaagaacccacccccatcgaggaagtagcctcctacaaaccagagaaaagctggaactacgagatcggtatccgtagcgagttactattccaacgcctaagcgcagaattgacaggtttctatatggacattcaagacgtgcagttgaccaaattcgtgaacagcggcaacggccgtatcctcaccaacgccgggaaagccaaaagctacggtatagaggcctccttgcgtgcccgtatcatcgatgggctaaccgccgacgttaattacggtttcacccatgctacgttccgggattacaacaatgggaaagaggatttcaagaacaacttcatcccatataccccacgtcataccttcaacgtaggactgcaatacacccgcctgttccgtaacgcatggatagaccaattctccgcctccgcccaattcagcagtgtcggaaagatcttctggaccgagcgaaacgacatctaccagaaattctacggaacggtgaacgcaaaggtaggcgtacgcaaaggtatcgtcaacgtaaacctatggagccgtaatataacgaacacccattactctgcattttatttcgagtcattcgggaatccgtttatccaactaggtaagcctttccagatcggtgcggaggtggcgatcgccttttaagcgcaagcgttcaatagaaataaaaaacgggagagccggttcttacaccaactctcccgattactttattccgactttcctatattcggtaacttacttcaaaaactataatccttcgatcttctcttccggtaaaccggtgctctgggcaatcaaagatttagatacccccgactcttttaaattcttggcgatagcatatttctctgataggcgacctttctccagaccttccctcaagccttcctccaggccttccttcatcccattcgcctttgcttccgctatcgctttctcttttgcttcctctacttcctgcaagaaagtctcttccgcaagacggttgacattgtagcgatccacggcacggtcataggcgagacgattctccggagagagattcgccacggcggccaaacgagatagatgagcgaacacctgttctttcaaggcatccggcattcgaatccaatgttccatattctttaacgcataaaaaagtctttctaataaagtttcgcactcatccagttccttcgtaaaataagggaactgcaaatagatctgccggaaatgagggttcagcgtctcatgactttctagatccagaattccagaatccacacggaaacgatccggtaaatccggctccttgaaattcatgaaaaaaacaccatacaccgtatgtagcttatagattgcgccatacgacatcgaaggttcccgcacctccagcccttcctccccgtcatccggtgagtgtacttccaccgctagcggggcctcaatctgacggctcaccgcacgacacatataatataatgttcggtccacgaaattcagatgcttgcggttctgcatctccacgatgatatattctcccgtggaggtacggcaatagaggtcgtaaatgatccccttgtcacgtacatgctctgcatgatcctccttgtcgagaaacatcagatcctcaatccgatgctcaccagccaacaactcgttcaataacgtgatcaagaacggcttgctagctggctgaccgaaaataatcttaaaaccaatatccgtaaacggattcacgaactttcccatagctaattatttttagttaaacctattgtttattctagaccgcaaacatacggaatttttatcaaagaataaaacgcaagcattcaattcttttcaacataaacctatggagccacaatataacgaaatcgggagagccggctattacaccaactctcccgataacatttcacataaaaacaaaatcgatcttttttatctagctattttaaaaatcgtaagaaatatcagcttaaagtactcaaacaatgtaggatggttaatatatctcatattgagttcaattttcgccggcataatatcctcaacataagttttgtcgggatttgaagactgtccaagtaacctattttcatccatatacactatagatgcgtaatctgtaatacccggcctgacagccaacacacgcctttgttcagtcgtatacatatcgacatacttacgcacctcgggccgaggacctaccaaactcatatcccctttaagtacattgatcaattgaggaaactcatccaatttatacttacggatataataaccagaccgtgtaatccgtggatcacgccctcctacggtaataagtcccttcttatcagaacctacacgcatacttcgaaatttaagcaactgaaaatctcgattgttacgtcctacacgaatttgcctataaaaaacaggtccggtagaatcacacttaatccaaattgccagaataacaaacaaaggacttagcaagataagacctatcccgctggctacaacatcaaaaaaacgtttcaaatcgattgattattttattgggtaataatatcaacaaaattagaaatcacatactctacgtcctcattcgtaagactggtatgcaaaggaagagtaatctcgttatggtattggttgtaagcattcggataatctacgatatcaaaacctaaatttttataggccgtcatcattggtaaaggcttataatgtacgttacaagcgattccacgttcagccatccgctctatcacagcatttcgatattccacatcctcaccaagcaaacgtactagatacaaatgcccactcgaagaatggtcatcaccaaaatgatccaagacctgcacatcgcaccccctcagtccttcattatacctctcaataatctgacgacgacgatacagcatttccggataacgcttcaactgcgcaagaccaatacccgccattacatccgtcatattacacttataatacggagcgacaatatcatactcccatgctcccaacctcgtcttagctagtgcgtccttgttctgcccatgaagggaaagcaattgaaactgtttataaagagactcgttgtcaaccccatcatgatttctccaagtcaacgcacctccctctgctgtcgtaagatttttcacggcatggaaggaaaacgaagtaaaatcagcgatctcaccacacatctttccatgccatttggcaccaaaagcatgggcggcatccgcaagtacgataacccgaccgtatgccttctggatatcattcactggcgaaaacaaatgtttcttgctctctacggcagcgaatatcttatcataatcacaaaccacaccggcaagatcaacaggcagaaccacctttgtcttctccgtgatcgcatctgccaacttatcataatccatctcaaacgaatcaggagcggtatctaccatgacaacctttgcccccacatgacaagttacacttgcggtagcggtatacgtataagcggaagtaatcacctcgtctcctggcccaacgcccaaaacacgcaatatcaactccatacaagccgtagccgaattcaagcatacagcttgatccgtttggcagcacatggcaattaatctctcaaattcttttgtcttaggccccgtagtgatccaaccggaacgaagagcctctgatactaaataaacttcactttcagttatatcaggaggagaaaaaggaattttttttatactcataacctcatacaagtttataattattattaatcattcaatcaaaatcgtaaaaaacttttttgaatttatcataaatatgatcaaatattagattatctgcaatatattttttcgcttgcttacctattttttctcttagagaacgatcatccattaattttataatagtatcagccattttttgaaaatcagttcggataaagatatgttctccatcaacaatcccctccagtccttctgctccaatttcagttgtcacaacacagcaaccgattgacatcgcttcaataattttattttgtactccagctccagaatacatcggaacaaccacaacagaagctttcttcaaataaaacttaggatcatcgacaaaccccgtaataataacatgctcagatgcaagtcgacaaacagaggcagatggtcgagagcctacaatataaaaacgaacggatgaatccaaaagcaaaataagaggtagcacatatcgaacaaaagtcgttacagcaactatatttggttcataaaacatagatcctacaaaaacaatatttcgagaatcattaggaataataagttgatcgtcaaaatcaacactattaccgattacctcaatatgtttatttgaaatttctagatctgcatgcctcaaaataaactgacgatcgacatcggatataataataaatttatcaaaagattttaaaactttattctcataactaattaatcgatttgcctcgaatttataaaccagcctccatatccaattcgcttttaaagaagctccaatatagttcattgaaatagcatcaacataatcaattatcttattacacttacttccatcaacgtacggaacggttctaatattattacaaaaaacataatcatacaaagataaatgttcctgtatataactcatcatcctcggagaataaaaataactacattgtaatggtctagatttaaaaaagcccaataatgcgcgtaatacacatttccacttgggctctaagaattcacttatttgtcgacaaaaacaacgcaattcggttagatccgcaaatgttttataaggattacaagtatataccaaatcaacttcaaatatttgtgacaacatccgaatcatttgagatgtacgaatagaagctccgtcttgaactggaaatggacgtttagaactaattacaagaatacgtttacgagaatccatgacacaaataatttgctcacaatttaatcattaggcaattgaaactttacaataaaatgcctctctcttttttccactggaggcaattgcatataatcatgataaagattggtcaaataccgatcatagtcagcaggtatataaacgatttctccttcaaataaagcctcttttggaggaaaatatacagaagcatcaaatatttctccgttataatattttctaccagtaggaatacctagaggattccctctctttgaagaagccacaaaacgatcaaaccaataaacccatttcgcatgtggaataataccaaagatagatcccagcattttcttaatttggaatcttctctttaacgatgaatctagagatacaaattctgacaaagactcgcttggatattgcgcatataaaaccatgatggatacaaactggattacattggcgataaaaccttttatagcttgtgcgattttatacttaggcactgaatctaaagcaaacacatcaatatataatcctttggggaagggtgaattctcattaaaaagctctatattaaaggagttctttctatatatcttcaagaacacagtttttgcatcagtgtctctattaggatagtcaaactcatatttattccccaatctcccctccttacacaatcgaatcaatttttcataatcatcacgcctcatcattacgtctaaatcatcatcccaaggaataaaacccttatgtcggatagcccccaaacaacttccaccactaagcattaatgtcaagccttctttttcacataatttcgctacatccctgtatatatccaacaaagctcgcttcatggcagaagactccgaagatgtcatctcatgtaaataattcgttttatgagctaactcattcatcaattcactatcagatttcatctttacggtctttttttaacatccaccacttctccggtcagggaagaaaatatagtattcaccgacacagacgcaacaacacttgatttcaacaaggtatcctccggttctatgccaaaatttctctcccgcataggggtcttagtccgttccggattaatacaattgatacgaataccactatcctgccactcttcactcaacgcttgtacaaaattcacgatagcggctttagaagatgaatacaagctatataattgacgccccctcgtataagaactggaagtaaacagcagcagcgcccctttactcatttttaaatatggataagattcccttgctacaataacagctccaagataattcacatgaatacttttacaaatctcctcatatgtcattgtagccaatggctcccgattcaagactccagccgtattgacaaccgcatctatacgcccttccttatccatgacagttctcaaagcatcagccactagagccgaatcggagacatccactccattctctgaacggctgaaagaatagatatgcgccccgtactggcgacaaatatggataatatcaagcccaatcccatagcttccgccaaaaacaacaataaccgatgaaggcaaagcggctatagtcttaggagttaccgtttcattctgttgagcgattgattttagctgaaacaacttatccaataaaaacagatcttctttgtaagtcaatttcatattaaactgttcacccttgactacatacacgaattcttccggaagatatctgtaaacaactccacaatcatctgtcgtttgaaaatcaagatctttcaatgctaattcataagcccgctttatcgtagaacgtttaaaagcttgcggagtctgcccattacgcaaatactcacgagctggtattcctgtaatatggtcttccacatccacttgaatgattgtatcagtcgtcttgatcgcaacatccaccgcattatacgttttcaacgcattgatgcaatcagtaataatacgatcattgaccaatgggcgaaccgcatcatggaagatcatattcacctcttcctcataagcattaatcgccgctaaacttgaatggtaacgttcctttcctcccttgaggattttcttcatcttggaatattcattcttcaccaagatattctctacctcctgcacataattaggattagaaaccacaacgatctcatctattaacggatgattttggaaaacatctatcgtatgttcaatcacttttttccctgccaacttcaagaactgtttaggcgtcgcatcacctaaacgttgaccgaagccaccggccaaaaccacagctatatttctcatgatctacgtttatatatattaaaatataaataaataccaataacaaatattggataagcatataaggcgcaaaaagcgactaatttccacttcttttttacactcctattaaccaaaaaatattgaacatatttcttaaaattcatatcatttaaaacctctttaacaatacgattagctctaattgaaaaaggctttttttgaggatatttaaataacaaagcattaccaacccaagtaaaaataagttctttatacaaagcattttctttcaaataaattttatttttttgcaccaagaatttttccatcatattcacagtatacagtacatctttatccttctcttttatcgtattaattatactatcttttctattccatctataataatagtaaggagaatccatcacgatcaaagaagacgaacaaatcaaagccttaaacacaaataatagatcctcatataaaacacctgtatcaaatcttaattcatttttctccaaaaatgatctattaaagaccttattacaagaagaagctgtaaaacactcatttttcacacaatgtagcaaataagattcacctgtttcaaaacaagttttccccttacttatagggtcttgcatataaacctcatcagcaaagcgatatcttcctaatacaattatatcaacctcattattatacgataaaaccgcctctatttcttcacaagtattcaaagatatataatcatccgaatcaacaaacagaatataatctcctactgcattatcaataccaacattacgagtatatcctaagcccatatttttttgatctataacacgaattctatcatcaatcctactatactcttcaattaaagataaagagttatcactagagccatcatttatcactacaatctcgatatttttatatgtttgatttatcaacgagctcaagcactcattgatatatttctcaacattataaaccggaacaattattgaatactttcttttcatcatttacgaacagataaaacataacaccagaaaaaaattcctcctagaaacaatgtgaaaatcagaaaggaataaacaaacaattaagcttatattttcttttaaaccaataaatcaattgaacacaaaacaaaacacaaaaaggtctatataaagctgttataacacttaaaggctccgctcttggagacataaaaaatacaggaagcacataaaacaatatatacatatatgaatattttttcttacatctaccggcaaatcgcataattataaatgtacacatataaccaacgatcataactccgaacatattccctaaaagataagattccgcaatcgcactacttcccataccatgtccgtttaaataatatctaggagatactttatacgacaaccagtctgcccaagaatacccttcccgtaccgtacctaaagtttgtccattaggtattcctaatcccaaatactccatcaacctattttctctaaaactatttgttattggcccaacaaaataaagccatccattagcaacttcatccacatattgtatcgtacggcctatcgtttgaatagaagtgccttgttgccaaaaaaaagattgaatcaattgcgtgaaaacaacatcatcctttttttgatctaaatctttaaaaccactatccctaaaatcattaacgagttgagctacatatattaaagaaaatccgatcaacacaaaacgtaacatccatctccaattcactctaatacctctaatacctaaatagacaagaaatgccaatacttgcgtaaatgttgcagatcgaccaccagtacctaacagtatcaacaatgtaaaaatgtaaaaacaactcactaatatatattttttccctatgggaaatgtacttaaatacaagtatattccagccacacaaagatcatcactaattctcaaaataggattatcaacagttgttgatgattcatttaaatacaccgccaaataaccattttcaacaacaaattttacagcttgatataaatacagcaaatatggtacacaaaatgatataaacaagaagaaacccaatcgacgtatttcaaatatcaacgaatcatttttcacgcacgttttataattatatctatcaacaaagagacaagaagacaaaaaaccaacaaatgaaaaaagaagataaaatataattgaattcaacatctcaaattgaattgacaatgagaaataagaccaatcattagcccacgtcgagacataaaaataagcatcttcaaatcctagcgcatctaaaaatacacgagacataataaaaacgccaaacgctaaaacataaaacgtatataaaagagaatcaacatccttaacgacaagcaacaagactatacaaaaaagatatatagagcatgaataatatttcaaaaaagacactatcacctcacttggagattgtacccacagaataaactgaagaaatattaagataaaaaacaaaacaattaacccctttatttttttcatatattcaaattctaataaaaacaagtagaatatatttcatcttcctttaaatacatccataatacaatattcagcacctcacgtagaactttcatctaacaatgaggattatatcaaccatctataattgttaaatgacacatccggacaaatcgcatcatcaggtttctcattccctgagcaacaaaaagcaaggctaaagtatctaaaacagagaatacaagagtggttaataatccagcaaaaaatgtcgtattttctttctccattgaatatctcattccaaggaaaacaatcactccacaaagcaatgttaccaccaaatgcttcgcatacataaacacgtatattctcaatggctcatccaagcccttgcgaaataaatagtaaggtttccaacaaaaaacgactagaaataagctgatcagaaccccggataacacaccatgcaatccaaaggaataccccaagatgatagatagaccaacattaacagacgcttctatcaccggagcccaaatatcgctaaataagccataagcattaatataagtatcgaccgttgttcggcttaaatttataaacagaatagccgtcatcaacaacaagctcaaggaatccataacatattccttgcctatccaaaaggagacaaatgatggagtaaccaaaagaaccccgaagcacatgatacacgagaacaagaatcttatagaaaacagttccgcaaatacactcatgatctttcgcttatccccttcagctatcaaatttccaaccccggcattcacactgttaaacagagccgtcatcaaagtttgaacacccattacaatcaacatataattgccgtacaaagcaactatcgttaatgtcgtataggcatatataataatgggactactctgcgtcaacgcaaatcccgcaatcttatgaaaaaacaactgcttgaccttcgtgagcacatccggatatttcctagccaactctttacctacatacaaatcagtctttaaacaaggataagtccgggcgatcacccgattcaaagccaccgaagccaccacagcgaacaccacttccaataccagccaccaaacatacccattagataaataccggatcgccaatatttggcaaagcagtttcgccaacattgaggctttgtaactatactgtatcttatactcctgctgatccgcagatagcacaatctgcttataattaacaaaatagctcaatagtgcgctaaccaacaacgccccgaaagaggcatacgcataccataacggcaatggcatcttggcgaagatccaagggaaaaaggccatcaggactacactcccggctattacgatccatgcgatacgccgatagagccatccttgcaaggatacgatctcattaattgcgttcgcatctttctcggcaagcggtttataaagggtacaagagatagccgatcccacccccagctctgcgaggttcaagaattgcagcaaattagtagccgtggtattcagccccagcacctccgcccccaagtaatccaagaagagctttcgggaaaagaactggaggatcaagttgatgaaataaaacaccaacgctaccgaactgttttttatgctcttggatgttcgcgaatctgtctttgccatatcttcgacaagcgtatcttttgtcccaagcagtgggagagcactgtcccaaggcatggaacagataactccttccggttgggaatctactgttcccttaccggggaagtctctgttcccttatcaggtaaaccgcctttactagtactggtaatagcgatttagcgcaagcatctaccccctatagccataccccttagccccagtgttcactggagtttgagaaggtaccgaaatatcggattaatttataaattatttgtttttaaacacaacagttcttgtgtcgtaactattcagcatgttgtgtaaaacgttctgaaatctttttcccactcttgcaataacaaaatagattcctctacttacctcaaagcagagattattctttcttttcacaagataaaaattctatttttctctatctcttttctaagggcattttactgtgccctaaaccgggttgtattaaaattttagaggatatgtcaaaactcaattttagcccagatgagcttttgatttgaaacttgaacatccttaaagacaaaaagaagagtcgtaccattactcaaaacagagcttgatacgcctcttttaggtcttgtaaggacaatctgtaatttttcggagaggtcattttagttttgacacatcctcaatccaatgaaatccctagctgagctgccatgtaatttaacctttccaatcacactgtgataagtagcagccatttcagcaccggcatcactaccgtaatgaagtgaattgtttcgttgagtagtaagcttccgaatggttcgcacaacaaggttgctatctatcggtagttccccatcatccaagaaagtaaatatctctttcctaaatcaattcagataattaagggcttctgtataatactgacttctaaattctgaattctttgactgtccactgtccaacaaggtacgcaattcgattaggagtctcttcgtttccgtaagcctgatacctctgaaagataatacatcttacaacgataagatgatacaccttacattaacaagatgatacatcttccgcacgaagataaaacatctttatcagactagagtaacctgtaactctcaacaagacatagaaccctcgataacccaatcccccaacgtatgccgctcactatcaaaattaatcccaacctttacgatcggcaacccacaaagagcgaagcgctccgggtaattgcgcaaattgatttgctcaagggctatatccgcggtcttgtttaacttcaattccacgacatagagtgttgtcggtgtgcgcatcaccatatccacacggcctttcggggtacggacttccacgtccacatacattcctagcaggctgaagatcgtgtaaagcaaggactggtaatggccctcgtaatccgtattgtcacattgggggatggtggacaggaaggtctgcaacagacgcagggcatcgtccatccgctctccagcgatcgcctcgaaaagaagggctactgtagtaagtccatccgctgtgtattgatgcaaataattgggcaataaactcttcatcaatcccatacgtacctccttgtttgggatgtcgagcgtgtacaaattcgtgagcgaggaataatcctttatcgtgatgtaaccgctctgatagagcaatggcgtaatatcgaccatccgttccgtgggtgcgtcaaacgactctgccaaaaccttgcgtgcgcctatttgctggggtttcacgtgatacttgttcagcatctcgatcaaataggtgggcgtaccgctaccgaaccaataggaatttagtttactgtcggccaaggcgttcaacaagctgaacgggttgtatatatcgggcgagggccacgtgaaatggtaaccgtcataattcgatttcaaggcacccaaggcaccctccggagaaacgccgaggttgtcggccaaacgaccgatatcctcgcccatctgctcacgcatttcctcctccgtgatgccacagagcgaggcgtactccgggagcatgctgatattcttgatattgttcaactcgctgaagatgctcaattgagagaacttcgtgatacctgtcaagaatacgaaacgcaaataaggatcgcaggctttcagcggactatagaagttacgcatcacgtcgcaaagcttcggcagctccttctcctcatgcaccacgtccagtaagggagcgtcgtactcgtcaatcaaaacaaccaccttttgaccggtctgggcgtaggcacgtttgatgagactttccagacgttggttcgtataaatagcgctctcatcacgtccgtatatctgctcgtaaccatacaatttcctctccagctcactcagaagccgctccttgtccatatgctttgccgtgctcatgtcgaaatgaagcaccggatagcttgtccactccttctccagacacttgatagccaaaccctcaaacaaatcctttcgcccctcgaaataactatggagcgtagaagtaagcaacgactttccgaaacgacggggacggctcaagaatatataaccagacgcaccatgtgtcattcgatagaccaattccgtcttatctacatacacataattcccctctctcaatttagagaatgtctgtattcctatcggatataatcgtcgcccttccatcttcgtctctgtttattggttcgtcaagacaaatataacgctatttccctaaatgatcaattttcagtcctctattttggcttatcgcaccataatactcaaagcaacacaaaagttcgcttttcgaagaagatatactgacttgtcctaatcagtatatctcctcaaggcaagtcagtatatcttctcagagctagtcagtatatctccttttaaaagtcagtatttttgacaacttagttattttctatcccacacatcaatatccggttccctatttatccaacgcctcgtacttggagtgccggcttttgaactcggggacgatcgccttcatcttgcccacgatggccatatcgtccctcgagcggcctaggccgacgagttcatctatatcttggcaaaccgtatcataatcgtactcccgtaccttggcgatcttgatcttcggatggaaggtaggcagcgtgatctcctcgtcgttcagtacctcctcgtacagcttctcgccggcacgaagacccgtaaaccggacctctacgttcttggcgcccgaaagctgaatcatacgtttcgccaagtcgatgatacgcacgggcttgcccatgtcgaagacgaagatctccccaccattacccatcgtacccgcctccaataccaaccggcaggcctccgggatcagcatgaagaaacggatgatatccggatgcgtcactgtcacgggaccgcccttggcaatctgttcacggaacaacgggatcacggagccgttagaacccagcacgttgccgaagcgggtcgtaacgaactgcgtcacgccttccacatggccctccttgatcgccttgtcgaggctctgcacgtaaatctcgcagatgcgcttcgagcaacccatcacattcgtaggattcaccgccttgtccgtggagatcatcacgaacttcctcgtgccatacttcacggccaagtcggcgatcacacgggtaccgtccacgttgttacccacactctcgcaaggattatcctccatcatcggaacgtgcttataggccgccgcatggaatacataggcggggcgatgctccgagaagatctcctccatgcgagacttgttagcgatgtccgccaccaaggtataggcgttgatatcccgccaatccctcgccatcatcaagcggatgtcgtgcaagggagtctccgcttgatctaccaagatcaaacgatccggagcgaatgaggcgatctggcgcaccatctcgccaccaatgctgccggcggctcccgttatcaggatgcgttgaccacgaagcaagcggcccaccgcctccatgtctatctctatcttttcccggggaagcagatcctcgatctcaaccttccggagttgtgtatgcatcaaatcgctcctgccatcccattcttgcgccgccggggtcacgtagatcttgatccccgcctccgccaaacgggccaccatatccggctgttcccggatggagtcgctcttcaagggggagacgaaaaggatcgtcgcccgctcccggcgcatcgcatcgatcagctcctcatcgaaagggtacacacgcactcccatcaatatacgattctgcatgttcccggcctccgagacgaagcctgccagcacgtactgtgcgggatcttggttctggatgctcttcgccaaactgataccgccctgcttcacgccgaagataaaggcacgctcagccttcgactggcgaaaggtcgtcacgtagaaatacttcacgaacacacgcatcgcccacatcaagctcatcgccagcagggaggatagcacaaggtctcgtttacggatatacaccaagtaaggcgaaaaatccgtaaactcttggaaggtcaccacgcaaaccacaccgaacagcacggcgaagcccacccgttgcaaatccacgaaggaagagtaacgaatgatgcccgaatacgtacggaacagcctaaagcccaccagataaggcactaggcaaacaccccacgtgagcgacaggtgccaaaagatgcccatcgtggcgaagatcccgttattcaaggcatataccagcaagcctgaaaacaggatcaccaagcaatccaacaggataatgctccaatacggcaacgctttccttgagaaataccacgttgagagtttagaaaaaaggttcatcatgaataaaatttttggttcatgtcagctggggcaagccctccacctcaccggcatgccatcttcggtagtcggtcgaagaggattcgggagcagttagtaccacgtaatccgtctcgtcccaccgcaagatatgtttacgggcgtaggaacgcagcgagcgatccgtaacggagaccatcacgattgggaacgggtaggcgaacaggcgcagcggtgtggtctcgctatccgggaacgcacgatgcagctggtaggccgaacgctcgaaagccacccaataaggtcctgtacaatataagtggatcgaggtatggttcatgcgctcacgctccatgatctcgttcaggtgttcgtttagcaatgcgaccaagcgaataccggagggaagggaagacatttctttttgaattatgaattgtaaattatgaattttgaattattcattatgtttcagccaccggtcgtaatcagccaaccgacggatcaaagataatttactcttcttcggggaggattcccggctccacggatcgatcaactcgtgcgcacgataataatagatactgctatccgtacagccataaagcgtaagtagtaataatgccaacgactgctccgcacggatcaaggataagaacgagacgatcgttccgatcaacgacttttgccgctcctcgtcccctaatatcgtataggcaggcaacaagagggaatagagcttgcaacgcatcacggccgaatccaactgcaactccccataggtacgcaaggtctcggccgccagctcacgatcggcagccgtaacgccacaacttccccaatgacgccctagtgcctcatgaagaccattttgtatccgggaattgtccaaacgggtatatacatgcttgccttcctcggccaagctgatcacctcatattcgcccggctgaacacgcaacaggggaacccacatccagttgtccacgcataccattacctcccgctcgccaacaccgggctgtattactacacttgcctcaacacctttgaaacgaccatccgtgatgcgtatccggtcacctttacgcaaataacccgcttccggcacatacaccggaagctcatccgagtaagaacgggccacccaacgcaagttttccatctcacgatcggaaacaaaaggatatgagccacggccatccacgctaggcaggaaattatacaagggaaaatctcgtttcaaacggaagatctcatatacagaagagcggataaacacataattgtagagcaacggacggtgagtctccaccaaatgcccttcacggcggcgcatctccacgaaagagggggcgaagaaatcgaacgtaggctcacccaaacgcactctgcgatccaactccttcttcaaacccttagcagggcctttatgacaagcgggaagagataacacataccatcttacggcgtggacatcacgcaatggtaaaggaggaagatcatgacccataggtaattcaatgccatatcagagcatcatattaacacactgataatctaacacttaaatcaaaaattcttttctattcccgaaaatttaaaagcaatataaaccatgtcaatatctcttctatcgggacgtgaaagagtggctacttgggaagtagcgtaaaaagtgagaaaatcattattaccctgctgtagagacggagtgtgctccgtctcccaccgtcaggtagtaatttaaaatacctatttgaggggatgagacggggcacgccccgtctctacacgatagttcgtacgatttttgggtgacgtgatgatgtagggaatatgaggtcgtttcgtctccattgtcgtgtccgtacaccacgcatagaaacgaaaaatagaggaaagacaaattcggaaaacaaacaaagcctacacaaagcctaaaaattgtttgttattcggtgttttttattaaatttgcggcgtggaagattacgctacttcccaagtagcctatcgcctaccccacctttgatacctcattatatatactctcgaagcaagccttgttcaccgcagacatcctatccaacgagaagcttttcaaatagatttgcgtggtcttgatcgattggtgtcccagcaattcgctgatcatctcgatcggtacaccctgttccttcaaggtcgtggcgaaagagtgacggattgagtacgaggtaaccatttccgtcacaccacaggcatttgccagttccttcaaggaactgttgaaatcagccaaggcagaggtatattcccggaaggcctcttcacccgttttcgtcccactcaagaaagtgaatagataaggagagtcccgaagcgtgtcggtcattaacgcagccaacaactccttggccacaggctgtatctcgaccaacatcggcgtacccgtcttctggcggttatacctcaagacaccactccggatatcactctttttcaaatgagcgaaatcgacaaatgccataccgcaaaacaagaacatcaaacacaatgcccgctgtgttttccgcagccccgaatcatccaacggagcggtcatcaacaaacgcaaggattccgtaggcaacgccttcttctgtttgcttttcactcccatgaaaatccccttgaacaaataacgggaaaaaggagcctccccattctccattgccaacccatacacacggcgaatcctacgcatataggtagacaccgtattccacgagcattcccggtcccgcaaatagtcttgatacctcaaaagcatttcccggtcgatacgggtataaggaatcacctcctgcccacaaaaacgcaggaatgaattcaaggcatcttgataactcttggcggacgaataacgtccttgctctctcaatcgggctatatacatccgcataccctccgctaaatcatactgtttcatattttcacgtataaaaaaagtaaattacaataaaaaacacggttaattcgtgattgtctacttacatttgcagaaaaacaaatactatggacaagatcgtagaaatagcccggttcacctatccggcggatgcccaaccgctgatggccctgttgaggtcggaagggatagaatgttatctccgcaatgagttaagcagccagatcatggccggttacgtagacgtaggcggcgcacgggtggagattctggaaagcgacgttccccgagccatgaagatcatggaggaaggcggttacgacctgccccgggaagacgagcaagcggaaccggtagaacaagtcgccggattcgcacgtcatatcccttttctacgaaaatatcccttagagaaacaaatcatgatcctattcgtcatcatagctgtctttttggctttggtgatttacttcggatcgcttatttcatcaaactaaacaaatgtaatcaatggcacgcagaaagataacaaatagtcaagccgtatgtatcaccttactatggggtgtcttatgctacatgctgcttgtatacagcgaaacgatcaatttcgacgtcatatttgcccttgtagcctccgctatcattgtgttcgttccgatctataagaatttcaagcatagagacgaataacatttcgtcgttttttcaaacttaatatatctaaatgatattttttatgcattttctctttcaattatttgctagtgtcaaaaattagcttacctttgccacgtcgttaaacaaacggcgtacggataacaaaatggtataacattctaaatataaaattcagtcatgaaggcaagtgaagttttagacaacttgaaaagaagatttccgaacgaaccggaatatcatcaagcagtatcagaggttttagggactatcgaggaagcttacaacgagcatccggaatttgagaaaagcaacttgatcgagcgcctttgtatccccgatcgcattttctctttccgtgtaacttggatggacgataagggacaaatccagacgaacatgggttaccgtatccagcacaacaacgctatcggcccgtacaaaggcggtatccgtttccacgcttccgtaaaccaatcgatccttaagttcttggcttttgagcaaacgtttaaaaattcactgactacattgccgatgggtggtggtaaaggaggttccgactttagcccgagaggaaagtcaaacgctgagatcatgcgtttctgccaagccttcatccttgagttatggcgccatatcggtccggacacggatgttcccgccggcgatatcggtgtaggcggacgtgaggtcgcttatatgtatggaatgtacaagaaattggctcgtgagaatacgggtacattcacgggtaagggtatcgagttcggaggttccttgatccgtccggaagctacaggttacggaaacgtatatttcttgttgcagatgctgaaaacccgcaacattgatatcaaggacaaggtagtttgtgtatcaggttccggaaacgtggctcaatatacggtagagaaattaatcagtcttggagcgaaagttgtcacgatgtctgattccgacggttatatctatgatccggatggtatcgaccgtgagaaactggattatatcatggagttgaagaacttgtatcgtggccgtatccgtgaatacgcggagcaatacggatgcaaatatgtacaaggcgctcgtccttggggagagaaatgcgacatcgctatgccgagcgcaacccagaatgagttgaacggcgacgatgccaagactttattggccaacggttgcttcgccgtatccgaaggcgctaacatgccttctacgccagaagctatcgacgcattccttgaggccaagatcctttacgctccgggtaaggccgctaacgcaggtggtgtatccgtttccggtcttgagatgactcagaacgcacagaagttaagctggagcagcgaggaagtagaccagaaacttcagagcatcatggaaaacatccacgagcaatgcgtaaaatacggaaagcaagaggatggttacgtaaactacgtgaaaggcgccaacgtagccggcttcatgaaggtagctaaggctatgatggcacaaggaatactctaggtaattgaaaattgagaattgaaaattagttagagaggagagattgatgatcatataagcgagggggataggctttgagaggctattcccctttcttatttccgacgaagtcccaattttcaattttcaattcttaattttcaattaaaaagcggtatcttagtgccgtaaatcgataagtatgataacagaagaacttaggaagctataccaatcatataccggatcaccggcagaggaaataacagagttaccgtcatccggctctaaccgccggtatttcaggataaaaggtcctgagacgttgattggagttagtggcacttctactgaggagaacgaggcttttatctatatggcaaaacatttccgggagaagggcttacccgtaccgcaagtatatgccagctcggacgaccattcattttatatccaagaagatttaggagatacgcttcttttcaacgccatcgagaaaggccgtaaaagcagtgtattcgacgaggaggaacgccgtttattacacaagacgatcaccaaactccccgacatccagttcttggggtccgacggtttcgatttctcgtattgccatccgcaagccgagttcaaccaacggtctatcctttgggacttgaattatttcaagtactgtttcttaaaggctaccgggatggagtttcaggaaaatcgtctggaagatgatttcttgaagatgagcgacgtattgttacgcagttcctccgccacgttcctgtaccgtgatttccagtcacgcaatgttatggtaaaggatggagagccttggtttattgattttcaaggtggacgaaaaggcccggtttattacgacgtggcttccttcctttggcaggcgaaagcgaaatatccggaggatctgaggaatgaattactatcggattatatcacggccctacgtaaatatatcccggtagacgaagcttacttccatagccagctgcgccatttcgtcctgtttaggaccttgcaggtattgggggcttatggtttccgggggtatttcgagaaaaagcctcatttcatccaaagcgtcccgttcgcgatcgagaacctgcggcagttattgaagaatgactatccggaatatccctatttatgctccgtccttcgtgagcttaccgggttgaaacaattcacggatgatatccagaaacatatgctggaagtaaaggtcatgagcttcgcctataaaaaaggaatcccgaacgaccctagcgggaacggaggtggattcgtattcgattgccgtgctataaacaaccccggtaaatacgagcgttacaatcatttcaccggtttggatgagccagtgatccagttcttggaggatgacggggagatcacgaacttcctcgagcatgtctaccatatcgtagacgcctcggtaaaacgatatatggatcgtggattcaccaatttgatgatttgtttcggatgtacgggaggacagcaccgttcggtctattccgcacagcatctggcggaacatcttaacaccaagttcggagtaaaagtacatttagtacatagagaacaaaatatagaacaactctttaaccctacattatgaaagctatgattttcgcggccggtactggttccagactgaagccgttaaccgatcacacgccaaaagcgcttatacctatcgggggcaaaccgatgctagaacacgtcatactgaaactgaaatcctccggtttcgaccagatcgtgatcaatatccaccatttaggcaaccagatcgtggattttctggaggcgaacaacaacttcggtgtccggatcgaaatctcggacgagagcgattatctgctggatacgggaggaggaatcaagaaggccacttctcttttatgcgggaacgagcctttcttgatacataatgtcgatatcttatcgaacgtggatctcaagaaactatacgatacccatgtacaaacgaacccgttggctaccttactcgtcagccagcgcaatacctcacgttatctattatttaataaggagaatagactgtgtggttggcgtaatcatgagaccggcgaggtaaaatcttactatccctattttgacccggatcaacacaacgagtacgcctttagcggaatccacgtactctcgcccaagatattggagctgatggaagaatggaccggaaagttctctatcattaacttctatctggctatttgcgccaaaaccgatatcagggcttatatggcggataacctaaaactattggatatcggcaagccggaaaccttggccgccgccgaggaatggctacgacaaaacatctaacaaaatatttcacacatgaaaaaaactagttttatctacttactcttgttgatcgcgctgggcctcagctcttgccagcaagagaagactttcagggttcttcaattcaacatctggcaggaaggcgctgtcgtaaaaggaggctttgacgctatcgctgacgagatcgtaagaagtaacgccgatttcgttacgttaagcgaggtacgtaattatcatcagacccgtttttgcgaccagatcgtggaagcgttgcagcaaagaggacaaacgtactattctttctacaccgaggattccggtctgttaagccgctacccgatcacggatagcacgaccgtctatcccttgaacgatgacaggggtagtatgtacaaggccattacccacatcggcgatgccgaggtagctctttacaccgcccatctggattatcgtaattgcgcttattacgatgcccgtggatacgacggaaatacatgggacgaggaacctcctgtcaccaatctggacacactcctatggttgaacgagcaatctgtccgtgacgacgctatcgcttgcttcctaaaagaggcgaaaaaggatcgggaagccggacggatcgttatcctcggaggggactttaacgagccttcccatctggactggaccgaggcgaccaaagatatgagagaccaccaaggattggttgttccttggcacgtatccgtcatgctggagaaagacggcttcaaagatacgtaccgtgagatcttcccgaaccctgtaactcatccgggacttacctgcccggcggactgtaaggatatcgctttagagaaattggtttggtcgccgaaagcggacgatagagatcgcatcgatttcatccattacgctccattcgagggattaacgcttacagatgtatgtatcatcggtccgaaaggtgacatcctccgtgggcaaagagagacggaagagacctccgacccgatcatgactccccttggaatctggcctaccgaccacaaagcggttcttgccactttccacttgaaataaaaaatggattcgcgagacccgtcttaccggctcgtctcgcaaatccacaaacaactatcttctcttgaaacgctatctttttatggtttcaataccacgccaagacttttcttcccatccatcttaatcgtaatcggagcatcaaaatgtacatgacgaagatattccgtctcctctacggcgggttgcgcattcaagaacgcctcatcgaaccaaccatctcccttaaatggattaaccgtaaaatagcccactccgaacgaagtcaggttctggaagaaatgggtaccttgactcgggtctacccgatagttctccaatccgcattccacaatcacccgtgcgttactgatatgcggccatttcaccggaatacccaaccaagagtcgctgctcccccatcgaccggggccgactaatacgtatcctttctcctgatcggtaaacgaacggttcatcttctcgatctcataagcgatcaactgattattggatgaattaaaagcgcccgtcttcacatagataatatcctgtacgtcgccaacgatgccatgccccaaaacactggtagaagaaaggatggtttcctcgttcttcaccaagctcagatcctcgtccataatctctttattatctacgatcggacggatttgcaacagatagaaagtcgcccttgtatgatccgacgggtccatgttgacagcgaactcaatctcgaccggacgacccatttcctgctgcccgatccgtaagatctgatccaacgtatccgccagcgggaatacgtcatgctgtaggatattcacgaaagaaaggatcttacgaccgcccggataataaccgtcacggataatctgatcgtacggatcgtatgtagagacaatatatttcaaggaaccttcagcgtcagcgtccttcaaacccagcttcaccaagttaaaggcatcatccaccgagaaagcctccgccatattcttcaaatccaaggcatagaaacgagtctgcgtttccctaagagcgaaatccatcgtactcatctgcaagatactatggggatgtcggggagagaaacgcaaggtttgcccgccgtcgacgatatacttacccaatcccaaggcgatattcgcgatcccatcttccgccttctcgttaccgatcggatagaaattcaaggaacgggccacgcccgacatcgtcggatagaaatgatcattataacgggagcccaccacttcttgcaagacgatagccatcttctcctgatcgatcaagttcgaggtagccgtcatatacgccttactgtccttataaaagacagaggcatacaccgccttgatagcgtcgctcaccgtacggagcatatcgtatttctcctcgatcttaggtaccatatacgtagaatagatcccggcgaaaggttgataatgcgaatcttccagcaggctggaggaacgcacggcgatcgggcttttcaccacatcgaagaaagccatcaagtcctcgattaaacgggagggcaagctggcccgcaagaaataccggaggatcgtctcgtcgtccgcatcgcccagcgctaccggatacaactcgttcgtctccatgaactcgtcgaagatgtcggtacagatcacgaccgtcttcgggatattcacggcaaaattatcactctccagcttagggtatcgcttcaccatcgcaccgataaaggcaagacctctacccttacctcccagcgaaccgtcaccaatacgggcaaaattactatactcatcaaaacgatccttctgataaaccgccacgacacccgtgttcttcatccggcgatattgcacgatcaagtcgaaaatcaatttccgggcctcatccatatccttatagtcactcacgtccacatgcttcaaaacctcggcgggcggaaacatggcacgggaataaaagaaacgggagaaatgattccgggagagatggtaaaccaacgaatcgtcgggaatctggaagactttcttttgaaggtctttcaaatccttgatgcgcatgatctcctctttcgtatgcggattcaggatcacgaaatcgccgaaaccgaaacgctgcatgatcttctttttcaaatcctgcggataactcttggaattcttatcgataaacgaggcgttcagttccttcgcatatatatggttgctggcctccgaagactccaacacgaaaggaatgatcaaacccgttttccgtacatactgtccgaacttataaccggcatacggatctttcacgccattgtgcataaaactcatgtccgagataatacccaacatattatcccgatactgatcaaagatacgtaccgcctcctcgtaattccgggccaatttgatcttcggacggccccgcatacgcaacgtacgctggtgatcgttcaacgcctccttcgcgaacatctggctctgctccagcacaaacttatataaatgaggcaaagcggacgaatagaaacgaatggaatcctccaccaacaagatgatctgtacccccacgctggccgtatcgtccggagcgttcatcttatcctcgatcaacttgataatcgccagtaacaactccgagttacccaaccagctgaacacataatcgatagcactcagatcctcgttggcgatccgcttagacacctctttcgagaaaggagtcaatacaacgatcggaatattcggataatgcacctttatctcgctcgccgcagcgaatatatcccggttatccatattcggcatgcaaatgatcaattcgaagttccggttcttcaactcattcaaagcctcttcctcggtagtcacctgcgtaaaccggggtgggtaacggaggcttaaggaagtatattcgttaaatatctgctcatctacacgcccgtcatcttccagcatgaaggaatcatatttcgtagcgataagcaatacattatatatacgcttattcattagattggcaaacggggtgtctctgaacaccaagtcttttaagttcggtataccgctcataatagattctgatagaattattcgagtcaaatgtaaggaaaaataataactattgaaacatgaaagtacgcattctgactctaactgaagatttttaggttttcactgataaaaagtaagcgaaactcttggtcattccaaagaattacctacatttgccaacagaatgttatccttttaaagaatataaatgctatgaagactgaagttattttatcagcgctagaggcaaaacatccgggagaaaaggagtatttgcaagcagtaaaagaagtgcttttatcaattgaggaagtgtacaaccaacatccggaatttgagaaagcgaaaatcattgaacgcctagttgagccggaacgtattttcactttccgtgtgccttgggtagatgataaaggtgagatacaagttaacttgggataccgtgttcagttcaacaacgcaatcggcccgtacaagggaggtatccgtttccacccgtccgttaacttgtctatcttgaaattcttaggattcgagcaaacatttaaaaacgctttgacaacccttccgatgggtggtggcaaaggtggttccgatttcgctccgagaggaaagagcgatgccgagatcatgcgtttctgccaagcgtttattcttgaattatggcgtaatcttggtccggacagggatgttccggctggcgatataggcgtaggtggccgtgaggttggttatatgtacggtatgtacaagaaattggctcgcgagaacacaggtacgttcacgggtaagggcatggagttcggaggttctatccttcgtccggaagctaccggcttcggcgctctttacttcgttcatcagatgttggagactcacggaatcgatatcaaggacaagacggtcgccatctctggtttcggcaacgtggcttggggtgccgctacaaaggcaaccgagttgggcgctaaagtggttactatctccggtcctgacggatatatctatgatccggcgggtatctccggcgagaagatcgactatatgttggaattgcgtaattccggaaatgatatcgtagctccttacgcagacgaattcccgggctctaccttctatcccggcaagaaaccttgggaacaaaaagtagatatagcgttgccatgcgctacccaaaatgagttgaacgaggctgacgctcgtaagttgatcgagaacaagactttgtgcgtagctgaggtttctaacatgggttgtacggctgaggctgtagacttgttcatcgagcataagcaattattcgctccgggtaaggctgtcaacgccggaggtgtagctacttccggattagagatgactcagaacgctatgcatatctcatggactgccgccgaggtagacgctaaattacatcagatcatgagcgcaatccacgaacaatgcgtagctcacggtaaagatggcgaatatatcaattatgtaaaaggcgcgaatatcgcaggcttcatgaaagtagcgaaagctatgatggcacaaggtatcgtataagaataaggtcagtttaggctaaataaaaacatagttatgaattctttgaaccttagttatggtttgagaatttcataactatgttttttaagctcatatcagcggactttcccggggttcttagcgataaaatccttccatcccgtatacttcttttccgagatcggattattggtttggaaataatgacaaacagccgccgccaacccatccgtagcgtccaattgcggaagcatggactcatccggtatcttcagatagcgttgtagcatgccggccacttgttctttcgccgcatttccattccccgtgatcgagagcttgatttttagaggggcgtactcgaagatcgggatatcccgctccaaggccgcagccatcgctaccccttgcgcccttccgagtttcaacatactctgtacgttcttcccgaagaaaggcgcctcgatagccaactcatccggatggtattgatcgatcaaggccaagacccgttcgaatatcttacgcagacggagataatgatcctcatatttattcaattgcaggattcccatagcttccagcttcggtttattcccctcgatcttcaagattccgtatcccatcacgatcgtaccggggtctatgcctaatataatacggtccttgatcatttaggtagctctatatcttccaacagggtagagaatcctgcgattttctctttataacgtcctatcaaatcttgctgcaaggctccgccttccttacgcacccactcattcaacgaatcgatatccctcgtatgaaactgtacggaaaaactttcaccttcctcattccgcgaatccaagatccgtctcaaataaggactataaaggataccgctctcggaggctttcggtatataactattcttcaaatattccagacattcatccacgatatccttatggatatgaaaagtcgtattataaattatcatcttctttcctttctcttgaaatttcttatacaaagatagcgcatatatcaagaaaagccttatatttgcacatgaattaacaagacggggcattagctcatctggctagagcgacagactggcagtctgtaggtgatcggttcgagtccgatatgctccaccaataataaattaagcggttacaaaacaagtagccgctttttttattgataaaaatcgttttgttttggcgttttgttgcatttggtgacgcaaatttgacgcaaataataacgctgttgcgttcattgcatttccggtttaacacccagtttaaccttacctcccaaacctcgctagaaccgcagccttatcaaacaaaattaggcagttacctaaaaagataactgcctaattttgtgagccgaaagccggacttgaaccggcgacctacgcattacgaatgcgttgctctaccagctgagctatttcggcaacatttgtttctttatttcgggcgcaaagatacagggtttatttgacatctgcaagaagattcgctaaaaaatcatctaaatctgcatctaaatcttttaatagaggatcgtccagacgaagcatatcatcatcgatgaagagaagttcctctattacaacaaaatcctcatcggtcaagctaacagaaagaggcttcatgaatcgggggacgtcaaaaatattcttggtagacaagatcgtaagaaccgccttcaccgaagcggcaacccgcttattgaatgcgttctcctcctcgttcgagttcacccaatcgaagataacgatcttttcgatcaaatgctcctcatcatcataaatttgcagttccccgctttccgcatcagcctgcacatataagtcgcttataaaattaccggactcatccttggccagcttttcaacagccgacgtaaaagcgttctcgatgagggattgaacctttgccatatttgcgttcatatattaattctcctttattcgaatatgcgtcaaaagtaataataattcaccgaataacgccgttaatcctcaccaaattgcacatttagtttcttatcggaacgaattcgttcggccaacgcctgtacatagagttccaataatttggtactcttatcattatcaccattattacgcttgaataaatcgtatgatttatgagcccactcataggcttcttttaaagctcctctcatctcatggcatagggccagattagaggccgccttcgcccggcttttccagttttccgtaccccggtaaagcccggaccaacgatcttccgccatatcccatttctcattagccgcataagcggaagcctctttccaacgtgaacccattccggtaaagtaccaacgagtctccttctcccaatgaggaacaaaattagcgtagaccttcgccccgaaatatttaccggccccacgcaaagcattctccggagagggcaataccttatccaagatcggcatataatccgcactttccgcccaataaatactatctttcatatgtaccgtcgccagtggagcctcacgatcgggaacgtaactgcgtatcacgccagccatctgcacgtcgatcattcccattacatacccttcgcccaaggtacctacgcttttcttcatatcgaacagcaagcggtcgatggagataaccgcatcggcaccggtctcatcgcatagcgacgctacttgcccttgggtaagtttcgtatccagaaacgcctgattatcctttcgaaccccatcatggtaaagcaatacgtcgttaaaataagaagcctccacgatagcctcccctaaagtacggcaagcgtcaaacagcgcactatccgctttcgctttgcaagtatcctgcttttctccctgcaaggtgtattcgtaacccgcatcctccggttgggggacggcattgtttacgataagtaccttggcgacattctcaggaaacgtcacctccgcaggattatacgtctcgatacctacataattaatcgtgctacaagcggacaacaaacccgctatgcctataaaaagaatgcttctcatcttcatctatttaaaagggggcgatttacgcccccacattatgtcaaatcactcacagccttgaaatagccgatagactccgcgatccccaagaaggggtctttcatgtctttctcgtattccaagctacacattcccgtgtaattaacttcccgcatcatacggatcagcgcagggaagtcgatctttccacgaccgatctcgatcccgactcccgccttcgaagaatccgtcacgtccttgatgtgcatatcgaatacccgggtatggtatttcttcaagtcggcgacaggatcacagccgtttcgcaagtcatgcccgacatccagacacataccgatacgggggtctaaatccttcgtatgctcccaaacgtccgtagcatcgggatacgtcttaatatcaggaccgtgcaagtggatagcgtaatgaaaatcatactccttcacttttttatccacatagggtaaaagctcgtaattcgggacaccgacgattaacttcactcctacccgcttcgcataatcaaacgcacgatctatctcttcctcactcttcatataaataggacctacggcatatcccgtcactttatgggcagcgcatttatcatgaaaagccctaatctgctcatccgtactattcaacggcaaatggaaatccttgatgcaaagataatggatatctaatcgttccaacgtcttcaacgtcgtatctaaatcaaaattaacgaaagtatatcccgccattcccagatggaacgggtttacggccttcggggcttttggctttacagggtccggcaaagcggcccgggcgatcgtggaggtacctaataaaagggcacccgccaatccttgtttaaaaaatgtacgtcttgagtgtttcatggtctattacaatattatatataatgtatactgtttatcttgggaaaataacgctaaaggtagagcctaccccttgctgggaagtcacttctatacgaccgccgagctttgtgaccaaagccttggagatagccaatcccaagccgactccattggtccattgcgtcaacttgacaaaacgatcgaaaacccgttccaattggtcgtccgggattccctcgcctgtatccgtcacataaaagcggatttcctgctccgtcacgtcatacccgaagcaaatataaccttttttcgtgtgcttgatagcattcgtcaataaattagtgaggacttgcgttaatctactccgatcggtataaagcgtaaaaggttggcaatcatccaatcgaagttctacattttcgggcatacgtaataaaatgatactatagatatctttcattaaagccttcatttcatgattcgccaaaacgaaagtcaacgtattcgactcgattttcgatatatccaatacgtcttctatcaagcgttgcaacaattcattattactttgtataatattggagagttcatgacgagtttccgcatcttcctcatcggcgatcacctgcgagaatccgacgatggcgttcaatggcgtcctgatctcatgattcatgtttgccaagaacgcagatttcaggtgatccgcctcctccgctttctcttttgcgatctttaatcgtatccccgcacgatgacgggcataggcgactatacccaagcccgcacatagtaacaacaccaagacaaatcctcctcgaagcatcaagatacggacacgcgacttttccgcctctagctccagtttcttactttgtatctctagtttttccacctctcgttgggttttcaacttcgctaaatcctcgtaatattttacccgcataatcgagtcgtgcacttctttagaatctctgtaagccctagccgcttccatccctcttccaagcttataatagagatccgccttaaaatcctccactgagacccaatcactaaagcgtttcttatccaagagcattagttccaatttgttcgccaaatcaatggccttctcatatttccccgctaaagcgtaataattcatccaaaggaattgaggcaggatttgctcggcattcatattattcttcttttcgatatcctccatcatcctcaagtgctgataaaccaaggaaggctctttttccgccacgtaatactgggccgagtaataatgatagcgatcttttaaaaaagcgacagtatgttccgcatccaattgagtaatgccctctttctcgcactcttgtatgcaagaatccaatttattcaaatactccaatcgcaaatccttcgtaagcaacagccgtaacacgtaataccaacgcatcctagaggcattacgttcttccatgcgagataagatctcccggcttaattgaataccctcctcatccaatcctatattaaaatagaaattcgctaaagcttggtttgccatatccaccccatccggataattaaaacaggtcgcaagattcctcaagctatccacctcccggattaccaatccctgcatcccctcattcgctaaagaatagatattccatcctttcgccctacataattcctcgatccggtttgtcgcgatgaaaaggggttccgctattttcaaatatattcgcaagctatccggatcttgcatatagtaataacgcatcaagaatagtaaggcatttcctttgtaataatcgttacgttgcctctgtgcctcttctaatagcaaatccgcatatactttatatactttgttatgcgtattggcataaagtaattcgttcaagcgtattagtttactactatccggcaaaaccttgatttctcttcgtaagctatcgacaaacgtgtcacctttcgccctatccggaataagcaaagttagaatcaacgtccaacaaccaataaaaaacaatctcttcatatataccttgaaaagttagcacgactatccattattcaatgcccggcaagttaataaaaatttaaatgccaagacatcaacataaacaagtttaatatcacattttcaacttatacaacaaaaagcctatatcaaccaaaaaaagattgatataggctcttatttcaaagaaacggccgttctatttattttgtcaaggcagcgatactttcctcgatagacttaatcttcgattcggcatcggcttgctttttcttctccatctcgattactttcgccggggctttgctcacgaagttctcattgcctaatttcttcatgacagaagccaagaaacctttttggtatttcaattcttcttgaagcttagccaactcttcctccacattgatcagattgcctaaaggtacggcatattcagtcgtacggaccaagaacgatacagcaccggccgctttctcctctaccttggagatggaagagagattgcacatcttagcgattacggcgttgaacgcctcattgtgctcacccacgatctgcaattccagcgcatccttattcggtatattcttttgcaaacgaatggtacggacaccaccaacgatctctttcacgatctcgaaagcatccaaataagcgctatccgcaacagctacttccggcatttgggcaaccatcaagctctcaccttccttacgaggctcaagggcttgccataattcctcggtaataaacggcatgaaaggatgaagcaaacgaagcaaggcatcgaagaaacctaacgtagcctcataagtagccttgtcgatcggctgctgataccccggttttaccatctccagataccatgaggagaactcatcccagaacaatttatagacagccatcatcgcttcgctcagacgatatttactgaaagagtcgtctacctcggcaatcgtcttatccagctgcatcttgaaccatttcacggcgatagcggaagcctccggctgagcgatcgtatcgtctaccgtccagcccttcaccaagcggaaagcattccatatcttattattgaagttacgtccttgctcacacaaagcatcatcgaaaggaatatcatttccggcaggagccgcgagcatcaagcccatacgcacgccgtccgcaccgtattgctcgatcaattgcaacggatcgggagagtttcctaaagatttggacatcttacgtcccagcttatcgcgaacgatacccgtaaagtagacgctcttgaacggcattttccctctgtactcatagccggccataatcatacgggctacccagaagaagatgatatccggtccggttaccaaatcactggtcggatagtaataattgatttcctcgttatccgggttattgataccgtcgaacagggagatcggccacaaccaagaggagaaccaagtatccaatacgtcctcgtcctgacgcaaatcagacatggtcagattcgggttaccacatttctctttcgccagttccaaagctttctcttccgtctcggctaccacgtaaccaccttccggcaagaagtaagccgggatacggtgtccccaccaaagctgacggctgatacaccagtccttgatattctccatccaatggcggtaggtgttcttgaacttcggcggatagaacttgatatcgtccttcatgaccggctccaaggcgatctgggctagatgttccatcttcaagaaccattgcatagacaatttcggttcgataggcacgttcgtacgctccgagaaacccaccttgttctcgtaagcctctaccttctccaaaagaccggcgttacgcaagtcttcctcgatctgcttgcggacatcgaaacgatccatgcccacatacaggccggcagcctcgctcaacgtaccgttatcgttaaatatatcgatagaaggcaaattatatttctcgcccaacatatagtcgtttacatcgtgcgcgggggtcactttcaaacagcccgtaccgaactctatatccacgtaatcatcctcgatcaccggaatctcacggcctaccagcggaacgatcactttctttcctctcagatgttggttcttcgggtcgttcgggttgatacacatcgccgtatctcccataatcgtctccggacgggtagtggcgacaatggcgtatccctcctcgcctacgatcttatagcgaagatagtacaacttactatgctcttccttatagataacctcctcatcggacagggccgtcaacgccttagggtcccaattcaccatacgcacgccccggtagatcaagcccttcttatatagatcgacaaaaaccttgatgacgctttccgaacgtttctcgtccatcgtgaacgccgtacgatcccaatcgcaggaagcccccaatttacgaagttgcttcaagataatgccgccatgctcttctttccattcccaagcgtgacgcaagaactcgtcgcgagtcagatcggtcttcttgattccttgcccggccaaacgattcaccactttcgcctccgtagcgatcgaagcatggtccgtacccggtacccaacaagcgttcttacccatcatacgggcacggcgaaccaagatatcttggatcgtattgttaagcatatgtcccatgtgcaatacgccggtgacgttagggggcgggattacaatcgtatacggctcacgaccgtctggctttgacttaaagaagccgttatccaaccaatactgataccacttcccctctacttcagcgggattgtacttactagcgatttccatatttttataactaattagtctttacacatttctcgatccgcgaaagtacaaaaaatatagacaaaaaacgctgagcatcgggaaatatagtcggccgagacaataggcattctctctcggatacgccactattctataaaccacgacatggtttgtacagaccaagtcgtggtttatacagatcacgacgtgatttataaagaccacgccgctattttgaaaatagagtgaatggcaattacttttacatccggggatttgaaggtttattcctataacaagcaaactatttataacggtttttctattccacgctattgcagtttcgcgtaaatgcctgtatcttcgcgtactataaaaaatagatatgagaaagcgatctgagtataaaggaggggataatcgacgtaaaccctctaaagaacgacaggtaacggtgggtgaaagtaacactttgctacctttcctgttcgagttattaaaagagcaaagccgttcatccgtgaaaggattattgagcaggggacagatctcggtaaacgggaaagtcacccggcagttcgatgccccgctgaaccctaacgatacggtcgggatcaactatggaagagggaaggtggaattcaacaatccgttacttagaattgtttgggaagatgatgacctcatcgtgatcaacaagcgggaaggtttgctatccgtatctaccgatcgtatcaaagagcgtacggcctaccgtatcctgagcgattacttgaaagaatgcgaccctcgcaacaagatattcgtcttgcaccgtctggaccgagacacatcgggtatcatgatgttcgccaagaaccagaaggtaaaagagcaactacagtccaactggagcgaggctatcacgcaacggacctacgtggccgtgatagagggacggccggagaaagacacggatttgatcgtatccaacctcgtggagaacaagcatatgcaagtgtacgtgacacaagatggtgacgggaaggaagcgatcacacgctaccgactcctgcaaacgaacaatcgttattcgctcgtggaactcgatctggagacgggacgcaagaaccaaatccgtgcgcagatgcaatccatcggccatccgatagccggagactctaaatacggggcggagacaaatcccgccggacgcttgatgctccatgcccgcaggctctgtttcatccacccggtaacaggcgaggagatgcgcttcgagacacggatcccggagaaattcacatcgacagcaaagtaatctatcaataaaggacaaaaaatgaagaagctcatcagttcgatcatgctggcgctaatagcgctggtagcgcaggcacaaatacttacgcctgtcaagtggaaaattaaactagacgacaagggcggcgcacccgagaaagagatcgtctttaccgccacggcggacaaaggttggcacctgtatgacatgaacctgccggaaggaggtcctgtttctacatctttcacattcgagacattgaatggagctgaactgattggtcaaccggttccttctgtaaagccgaccacggtttacgacgagcaatttgccatgaatcttcgttggtatccgggtacggtatcgttcatccaaaaactaaaagttaccgatcccgctaaattcaaggtagagggcgaggtggaatttatggcttgtaatgacgagacttgccttcccccagatcaaatacctttctctttcgataagaaaagtatccatgtagatccagctctggcagctaatagctcgactacagaggtggataaagaggacgccacggccatacagccggatacgcaagtcgtagcggaagaggccagcgagttgaacactccggaccctgccgctaaaaagacaccggctacgacatctcctaaagcgtccgacagcttaaccgatagcccgaatctttggtctccggtgatcgaccaattgaaatcgttcggcgacgctacggtatcggcggcggatacctcttggttattcatcttcttcgcgggtttcttgggaggtttgatcgccttattgactccttgcgtttggccgatgatccctatgacggttagcttcttcctgaaacgtacgaaagatcgtaagaaagcgattcgcgacgctatcacctatgggttatctattatcgtaatctatttggtgatgggcttgttgatcaccggtatcttcggagcgagcgcattgaatgatttatcaacgaacgcgatctttaatatcctgttcttcttgctgttggtagtattcgcagtctccttcttcggagccttcgagctggtattacctgcgtcatggactagcaaattggatagcaaggccgattcgacgaccggcgtattgagtattttctttatgtcgtttacgttggtattggtatctttctcttgtacgggcccgattatcggaaccttgttggtacaggctgcttctatgggtacggcggtaggaccggctatcggtatgtttggtttcgccttggcgttatccatcccgttcagtgtcttcgccatcttcccgaatatgctgcaaagtatgccgaaatccggcggatggttgaattccgtgaaggtcgtattgggcttcttggagttggcattggctttgaagttcctttccgtagcggatttagcgtatggctggcgtttactagaccgtgaggcttttatcgtgctttggatcgtgatcttcagcttattgggtgtttatctattaggcaagatcaagtttagccacgatagcgaagtaaaatatgtatctgttcctcgtctgttcatggcgattatctctttcgctttcgccatttacatggttccgggactttggggcgctccgttaaaggcgatcagcgcgttcgctcctccgttgtatacacaagatttcaatctatacaaaaacgaggtacacgccgcgttcgacgattatgaatccggtatggcttatgccaagaaggtaaataaacccgtcatgatcgacttctccggtttcggttgcgtaaactgccgtaagatggaggcttccgtttggacggatcctaaggtgaagcaaatgctagaaaatgattacgtgctaatcactctcatggtagacgataagacgaaactcccgcaacccatcgagatccaagagaacggaaagactcgtaagctgaagacgatcggtgataaatggagttatttgcaacgaagcaagttcggttctaatgcccagccattctacatcttattgaatgacgagggacagccgctcggaccttcatacgcattcaatgaggatgtttccaaatacatccagttccttcaaaacggattgaaagaattcaagaaagaacaacaataaaacaaacagagggccgggttctaccctgccctctttcttttacaatcattatagaataagtaaataatatggcaactagagaagagaagatggaagccttcgggcaattactcgacattctggatgaattacgggtaaaatgcccttgggatcgtaaacagacaaacgagagcctccgcacgaatacgatcgaggaaacctatgaactatgcgaggccttgatgcgtgaggataacacaaacataaaaaaagaattaggagacctgttattgcacatcgtcttttactccaagatcggcgaggaaaaagaagctttcgatatcaaggatgtctgcgacagcctttgccagaaactgatttaccgccatccacacgtattcggagatacctccgccgataccgctcaaaaggtagagcaaagctgggagcagcttaagttgaaagaaaaggggggtaacaaaaccgtactggagggtgttcccgcttccctcccatccgtagtaaaagcgcatcgtatccaagataaggcccgtaacgtaggtttcgactgggaacaacgtgatcaagtatgggataaggtacaggaggaatttaatgagttgaaaaccgagatagacaggatggacgcagataagatggaagctgagttcggagatctcttctttagcttgatcaacgctgcccgcctatacaaaataaatccggacaacgcattggaacgcacgaaccagaagtttatccgccgttttaattatctagaggagcacacgatccaagaaggtcgttccttgaaagatatgacattggaggaaatggatcaactgtggaatgaagccaaggccaaaggcttataaagcaaggataagggcaaaacaaaaggggaaccgacatcacgtcgccacccctcccttaacttaaacgccaaaactaaatctaaacaaaaaacacaaataatgataatattttactttttctgtttttcttcctttttattgtcccgaccactcttcatgaaattccggacaaacttatattccgcatttcggtacttatagaccttttcgggagaaagtatcttcttgaatctctcaaaatactctttttccaactgtgcctcttttatctcaacatccagacattcgtctatcactttgttataatcagcatctgtcggattctccttatgtcgaatttcttttgataacttacgacattcacgacctacctcaaattttttctgtcgcaactcattgcataaaggaataaattgtgcagcttcctcaggtgtaaggccaacttcagccgtaataaaagcattccgccttgcttcgaatgcctctctatcaaaatgtctttgctctttcttctcttgtgccgtagcattgaaagagagtagaaccgaaatcgctacaaatgtaatgaaaaatattttattcatacaagtattattacaaaaatcttcgataaaattactattttaaactttattcagaataggaaagttcctcatctaagagataattggcgtactgagcttccaaatactccaaatactcctcatcttcttccgcttcaatagcgtctaaagccgttgtcgggacttccgtccggaccagtaaagaatcagacgcagtactaccatcggaaccgtttattcccacgatagccttgaaaaacaaaccaagaccagcgaataccgcagccatgtacaaccacggacgaacacgatccatcaaggaaatccgtttcgccctctcctcctgcttctcggggagctgactcatgatccgctccgtaagcccttccatatacccttccggtacagtgaaaggattagttcctttcaagcgatctaggttgttttcttcttttttcatactttttctctttttatattgctttgacagcgattcgggcaaaaggtttaaacctcttttgttaaaaactcctcgatttttttcaccgcatgatgatacgaggccttcaaagccccgacagaggtacctagtatctcggacatctcctcgtacttcatctcctcgttatacttcatattgaaaaccaagcgttgtttctccggcaaggtaagaatagcgttttgcaatcttacctgtatctcgtcaccatcgaagtattcatcccctttcaaacgttccagcaaaaaggtatccgcatcgtcgatagatacgttattcatatttcgctgtttatttaggaaagtaatgcactcgttgatcgcgatcttataaagccatgtagataatttggcctcaccgcgaaaaagctcgatgttcgtccaagctttcaaaaatgtattttggagtaagtcgttcgcatcctcatgatccagtaccatctttcgtatatgccaatacaacttctcgccatacaagcttacgaccttggcaaaggcctcacgttgtcgggccgggtcccggagctgtactacaatttcgtcttctgtataggattgcattttttctattttgggaagtgcccagaacaggactcgaacctgcacgatcgcaaaaccactcgcacctgaaacgagcgcgtctaccaattccgccacctgggctttttttaatcattctgaagcgcaacctatcggtattgcgcatacaaaggtaatcgttttttccaattagcaagcaaatgaaaataaaaaaagcgaccgtcccttccggaacggccgcccatatcattaatcacgggagtcgattacatcataccacccattccgccgcccatacccggattcatcggaggcatagcaggagtctcttcttttttctcagcgatcacgcactcagtagtcaagaacatacctgcgatagaagcagcgttctccaatgctacgcgagttaccttagctgggtcgattacaccagcctcgcacaaattctcgaaacagtccttacgagcgttgtaaccgaagtcgcccttgccttccttcactttctgaacgataacggcaccttccttaccagcgttagctacgatctggcgaagcggctcctcgatagcgcgcttaacgatctcgatacctgtagtctcgtcctcgttgtcgcccttcataccttccaatgcatcgatagcacggatataggcaacaccaccaccgggcaccgtaccttcttcgatagcggcacgagttgcgtgtaatgcgtcatccacacggtctttcttctctttcatctcaacctcagaaggagcacctacgtaaagaacagctacaccgccggccatcttagccaaacgctcttgcaatttctctttatcataatcagatgtcgtattctccatctggatcttgatctggccgatacgagcttggatagcctccttgtcaccagcaccatttacaatggtagtggtatctttgtctaccgtgatcttctcagcggtacctagcatatccattgtagcaccttccaatttcaaacctttctcctcagagataaccgtaccgcctgtcaatacagcgatatcttccaacatagccttacgacggtcgccgaagcccggagccttaacagcgcagatcttcaaggaaccacgcagacgattcactaccaatgtagccaaagcctcgctgtcgatatcctcagcgatgatcaaaagaggacgtccgctctgtacggtcggctcaaggataggaagaaggtcttttaatacggagatcttcttgtcataaatcaagatatacggattctccatctggcactccatcttctctgtatccgttacgaagtacggagagatataaccgcggtcgaactgcataccctcaactacgtcaactgtagtttcagtacctttagcttcctcaaccgtgataacaccttcagtcttcacacgttgcatagcctccgcgatcaacttaccgatagcctcgtcaccatttgcggagatcttcgctacatgctcgatcttctcgaacttatcacctacagcctcagcttggttagcgatgctctctacaaccttagcgacagccttgtcgataccacgtttcaaatccatcgggttcgctccggcagtaacgttctttaaaccgacaccaatgatagactgagccaaaaccgtagctgtagtcgtaccgtcaccggcgttatcgtttgtcttggaagccacttccttaactaattgagcacccatgttctcgaacgggcaagtcaactcaacttctttagcaaccgttacaccatctttcgtgatgtgaggagctccgaatttcttctcgataattacgttacgacctttcgggcctaatgttaccttaacagcattagccaactcatccacacctttcttcaaaaggtcgcgggcatccatatcgtatttaatctcttttgccatgattgtatctctttttaatattgttgtttataaaaatgaattagataatagctaaaacgtctgcttggcgcatgatcaagtatttctcaccgtctagttcgatttccgtacctgcatacttaccatacaatacgttatcaccaacctttacaaccatctcctcgtctttcgttccgttacctacggctacaatctcaccctttaaaggcttttcctttgctgagtcaggaataataattccacctaatgttttctcttccgcagcggccggcttaatcagcacgcggtctgctaatggtctaatgttcattttcttggtattttaaatgttaataatattacgtttttagtttatgaactttgtgttcacgcctaagtctatgcgaatagtgtgccaaacgtattcacccgagttcgactgacaatatttcggacgaaatagacaaatatccgaagagataactgacaacttgtctttttgcatctctcaaaaggattatcaatcgaccagcagcgtattcatggaatatgcttttacgatcggagtatagactcgatcgcctatgcggatggaaagggaacgatcatcactggtctcattggcgataatcaaggcgatactgttatccgggttacggaatgccagcagattcgtataggctccttccgtttctaatttatatgcaccgggctggacataatggctgacatgtttcatcacgtagtattccggagtatatcgatagctcttggtttgcggatctacgacaaccaatgagttttgcgcccatccccaacgactgatccctccattttccaaagatatattccaatacatataggcagaaacgccattatccagaaaatgtcgcatcaacccccaagaatacatggcacccttccaatcgttcttgccatctccacattcttgctcggtttggtaaagcttcaacccgggataacgtttgtggattccggcgatagctcccttacccgcccattggaaaccgacaccttttacatatttaccactagcgggatctgtcaataccgtatcaacaagcgactcattcgcacgttccatcgtgccgaacataatatccactccttgaacctgcatggccggcccgagataattaccgataaaattagccaaagaagccgatgtccaacaacaactcgggaatatttgcgcagagttgaactcgttctggggcattatggcaaagattggaattccgtgtttcttataggcctcgataaatttagagaaatagagggcataggctttcaggtaaagagagtcttggataaacatatccgtaccttcatggccgaccttatcggccggcaagccatttcgatacttctcgtcataattctcacccgtataggcagaggcatagtgtttgttatatttcatccaagcaggagggcaccacggggaagcccacaagcgtaagtctggctgatacttttgggcgttcttgataaaagggatcaacgtttgttggtcattggcgatggtaaaatgttccatcgtgaaatcaccgtctacctcgtcatacgaataccaatcacgggagaaatcatttgctcctacaggcatccggcaaatcgtgaagttggctccgactccggggaagaaaagctcttccatgatttcctcacgtacacttggctccagcttactcaaggaaagccaacctaattcattaaaacaggctccgaaaccatcaatttgttgttgatgcttttctgttagaattgttatatcaatattaggtatcgtatccgcaagggcggagatcagatcgggttgctcagcccaaggggtattctcggttgtcgttacccactcggcccggggggtgaaagagcaggaagaaaggtataaagatattgagagtataaaaacaggtattttcatggtcgtttcattaatttataagtttagaaccatttaaacacggactacacggatgacacggaacacacggataaatactaataccgtgtcatccgtgtagtccgtgttccataatccactattctctaaaagcgttctatcagctcctcgatagtcacaagggtttgctcacccgtgagcatattctttaagttgattttattctcggccatctcattctctccgactatcgcaacgaacgggattttcttagcgtccgcatatcccatttgctttttcatcttagtagactcaggatatagctctgtacgaatccccgccttacgaaccttagcgatcagcggcaataaatgaatctcctctttctgtccgaagttcacgaatagaagctgtgtagtcttcaaagatccttccggatataaatccaattggttcaatacatcaaagatacgatcagcgccgaaagagaaaccgacaccagatacgccttccatgccaaatacccctgtcaggttgtcatagcgaccaccaccagtgatactaccgatctgtacgtccaaggctttcacctcgaaaatcgcacctgtataatagtttaagccgcgagctaatgtcagatcaagctctaattccgcacggattgacgtatgagagatgcgctccaaaataaaatccaattcggctacacctttcaaaccagtctcagacgcagataatacctctttcaaggtagcgatcttttcttgatttgaaccctgcagcataatgatcggctgcaaacgctcgatcgcctcctcgggtaaacccttggaacgaagctcttcattcacgttgtccaagccaatcttatccagcttgtcgatagctaccgtaatgtctacgatcttatccgcctcgcctatgatttcggcaataccggaaaggatcttacgattgttcatcttgatacacacacgaatgccaaaacgatggaacacctcgtccataatctggatcagttccacctcattgatcaaggaatcagaacccacaacgtcgccatcacattggtagaactcccggtaacgtcccttttgcggacgatcggcacgccaaaccggttggatctggtaacgtttgaacggaaaactgatctcattacgatgttgtaccacgtaacgagcgaacggaacggtcaaatcataacgcaagcctttctcacaagccttagcagcaaatctcaacgggttcttttccattaactcctcatctgagatgcccgcgaaacaatctccggaattcaatatcttgaaaaggagcttatccccttcctcgccatatttacccatcaatgtagaaaggttttccatggcaggagtctctatttgctggaagccatacaagtgaaatacttcacggatcgtgttgaatatataattacgtttcgccatttcctccggcgaaaagtcccgggtacctttgggtatggaaggtttttgcatgatcttatgttttaaatgattattctgtccgcaaaggtaatgtttttgctcgaaataaataagaaaataacaatgcccactgtaaggagcttacaatcgcagttataagcatcttacaatgggcattcaaacatccttacaatgggcatccatggaaagcctcttccgaggcttatcaatcccggcttcttccccccaagaatatcattatataatataataatgtagcaagcgaacctaacgcggcgaccacgtacgtataagcagcggaacgtaaagcatcctctgccttatcatgcgtataagcatttgttataccggcattgctcaaccacgctaaagcacgttggctggcattgatctcgaccggaagcgtgataaagctaaatagcgtagtcgtagcgaacaagattataccgaataacaataactgaggaaacgtatgcaataataacataccacccaacaacacccatgtcatgatattagaggcgaaactaacaaccggaaccaaggccgaacgcattctcaacggagcgtaagcggtagcatgctgcacagcgtgaccgcactcatgggcggcaaccgcagcggcggcgatactattgctataataaaccgactcactcaagttcaccgtctggttagcgggattgtaatggtccgtcagatgtccgggtgtagaaatcacctttacatcatagataccattgtcatgcaacatcttctcagcgacatcttttcctgtcatgccattcggcatagggattttcgaatacttctcaaacttgccctgaaggcgggatgacaccagccaactcaatagcgcaaatccaataaatataatccaatacatactcataaatttctatcttatttagttttataaaacaacgacaaaaagtttgccaaagacaaaaatggcaggagacaccccttgaggaatgtggtcttctgccattttgtacgatttataacgagtttattcttctgtatatctgacaatcgtctgttcacgatccggtcctacggaaacgatcttcacaggcacacccagttcttcctccaagaaagaaaggtaagcgttgaactcctccgggaactcatcctcgctctgcatcttcgtcatgtccgtcttccaacccggtaattccacgtatacaggttcgatcgtatcatcgatctcatacgggaactcattagtctcgacaccattcatcttataagccacgcaagccttgatcgtatcgaaggtatccaacacatcactcttcatcatgatcaattggcttacaccgttgatcatcacggcatatttcaaggctaccaaatcaatccagccacaacgacgtttacgtcccgtaaccgcaccgaactcatggcctaattgaccgatcttatctcccacctcatcaaacaactcggtcgggaacggaccgctacctacacgtgtacaataagccttgaagattccatatacctcaccgatattccggggagaaacacccagtcccgtacaacatccggcacagatcgtgttagaggaagtcacgaatggataagaaccgaagtctatatccagcatcgtaccttgagcgccttccgccaagaccgacttaccttccttcaaatagttattgatgacatgctcgctatcaatcaatttgaattgtttgagatagttcaaggcctccatccattgagcctccatctcggttatatcatattcatagttcaatgaacgcaagatcgcttcatgttttgctttagcggccgcatatttctcttcgaagttatgcaataaatcgcccacacgaacaccgttacggctaatcttatccgtataagtcgggccgataccctttccagtcgtaccgatctttccggaaccttttgcggcctcgtaagcggcatccaagatccggtgagtaggtaaaattaggtgagctttcttagagatataaagctgcttggtgatatcgtgaccactcgctgccaatgattccgcttcctgcttgaacaataacgggtccagaacgacaccgttaccgattacgtttatttttccaccttggaaaataccggaaggaatcgaacgtaacacatacttttccccgttaaactccaatgtatgtccggcattagggcctccttgaaaacgagttaccacatcgtaattcggagtcagcacatcgacaaccttgcctttgccctcgtcgccccattgcaatcctaacaaaacgtctactttcatcttttctatatttattataggctattaatattcttatttaactgacctttgctgcttaaacttgcatttactgcacaggccataaatgtacaaacaataatactccggcgtaaaacgagagactttcaagtttctcatatccgctttcaacgcactatttcgcagctcccgcatggtcccgcatctcgtacaaaccaaatgcaaatgcgtatcagcataaatcctcaactcatattgcaccgactggacggttatttgatgacgcaccaccaaaccggcatcaaccagtacatccaacgtattatagagtgttgccttactgacatggaagttgtcttgctccaaccgatccgaaagcatacacacatcaaaatgaccgggaaaagcacatatctccttgaatatagcatatctctcctcggttttccgcagtttcttctccgttagatattcggtaaacaacgcacgtatttccgtataaactttcgcttccatctcctaaagaccgcacaaacgacaaagttagcgcatttattttaaacgcaaagccttaccgataatattcaaactcgaattttaattcattatagatttcttgtaattccggcgtgtttcccgcagcctcctgaaattccttgaaaccgtctaggatcctttccgcattcccctcggattgacgcccataaaacttcatggcttgaatagacgcttgtttctctttcagcgtagatttaaaatccttagtctccgctagactacttaaggtttctgccaagaaagatcctaaaaccacagaagataagctgccacctcgcttgaaattctcggcccaagtaagaaaggcgaccgtgcgagcgaactcatttttcttatcagcaaccagatcagacgtgaagtcctccatataaggcagatgaacgaacaagttccggcaacaatgctccgcgatctctaaataaggaatctccttgacccaacgtttcgcctcatccaaaggcaacgtctcggcgggttggagaaaggtcgccaatatcttaaactcacggatgtcttctttccataaagccgccgctagctctccattcggtttatgcttacgggcgattccctttatttcggggtacggaaccccgaaatttaacttatatacgatacctttctcacgcatactcgtagaaatcaccccgttcatcgccaaacgaagttccttacggatctcccttatctcgtcttgtaaactttccatctattaattattataagtcggcaagaaagaataatcacggccataacgaagcatctgatctgtataaccttccgtgtagtccaagacaatatcagtaacctcaccgttagagttctttacctctttcatcacaggattgacaaaacctttatagggagccaagtttaacttagcatagcgctccaagacctccgcatgcagctccggatctactttcacgccgtatccttcaacaagattctttccggccgcatagtcaccctcactcttgatacgttgaatctcagcaagcaatgtcccaaacaactcacgtaacctcggatagtcattcacaaccacataggtcttgccatcccgttttttcagttcgatcacattcgcttccttccctttctcgtaagcccacttagcgatcaactgacggttacgcatatgcgcctcttctacattcttgcctagctcgatgcgaaccaactgggtcatcaagccattcattatatatttatagtattccgatttataagcctcgccgtccggaagcaatcccagttccaccagctttggatctgccaaataatacaggccaaacaaatccgcacgggtttcctccagtgtagagctataggctttcagcgcatccgggtccgtattttccagcaatttaccggaaccatgtcccagacactcatgtaaatccgtatgtagattatccgttaagaaaccgtactgcctcataccgttccgctccacgtcactccaaacaaactcttcgctaaagccatttccttgagacgccttatcataagcctccgtgatattctctatcgtaacagacttcgagccatgatccctacgaatccaatccgcatttggcaaattgataccgatcggggtagccggatagcaatcacctcccaacatagataccgtgattaccttagcgctaactcctttcaccttctctttcttgaaacgcttatctaccggagaatgatcctcaaaccattgcgcattatcactgatgatttttgtacgcttagtcgcctccttattcgtaaaattcacggtagactcccagcttgctttcattcctaacggatccccataagtctcgataaagccattcacaaaatccacctccgaagctgtatcctctacccaaaggatcgaataagcatcgaaagtcttcaaatcgcccgtttgataatattcgatcaatttcccgatgatcgctttctgcgtatcattctcggcgaaaggcaaggcttgtcgcaattgatctacgattttttctatcgcggcggaataaagccctcctactttccaaaccttttcaacgaccgtaccgttctcttttaccaaacggctattcaacccgtaagaaatcggggaaatggtatcctttcccattttcatttgcgcatagaagtcctctacctctttttgactgatgcctcccccgtaataattattagaagaagctttgatcagatcaccgtcaccgctttgtacgctacgctttggcataacgcccggatcaaagattaccggagcgatctcgatcatgaactgatccacgttttgattctcacgaagaggtaacttcttagcgtcgatttggtgaatacaatccatcaagaactcaggagaaaaccccggggcaaacttgtccaacgcataatgatgatggataccactggagaaccacacccgtttcaaataggtttccaaagccttgaattgagggtcctcccgatctcccttataattcgtataaatagcctccagtgtcctgcggatcgccagattatagcgtccattctgatcgaagaatatatcacgtcccatcaaggccgcttcggaaagatgatataatagttgcttttgttgcaaggacagggactcaaaacccggaactttatagcgaagaatctccagatcagcgaactgatccactacataattgaactccttatcggaattttgagatgccgtatccgactgttggcctgtacaagccgtcataaccatagctgtcataagcgataacattatttttttcatacttactacgatttgcttttcctataatatattacatctaaagtacatagtttgaaggcccgcattccaataagggccaaccgcaaagatagagaatatacagtcaatatcaaaggtttgagattttttctctacttttgtaagttcaaaagcaaagacaaaaaagagaatggaaatagcggcattagtttcaggaggagtagacagctctgtcgtagtgcatcaactcaaagaggcaggatacgatccgaccatcttctatatccgtatcggtatggaagacaaggatggctatatcgattgcccggcggaagaggatatcgagatcacctcatatatcgcccgcaagtatggatgccggttcgagatcgtctccctacacgacgagtattgggatcgggtggtaagctatacgatcgaatctgtcaaacgcggtcttacccctaacccggatatgatgtgtaataaatatatcaagttcggttgtttcgaggaaaaatggggcaaggatttcgataagatcgctaccggtcattatgccacgaccacggagatagacggcaagatatggctttctaccgccaaggacccggtaaaagatcagactgatttcttagggcaaatcacccgcctacagatacagaaactcatgtttccgatcgggcatttaatgaaaagtgaggtacgtgccatcgccgaggcccagaaattgccgagcgccaagcgtaaagatagccaaggcatttgcttcttaggcaagattaactacaacgactttatagagcgttatttagggaaacgcccgggaaaaatcgtggaactagagacgggtaaggtcttgggtaaacacaatggatattggttccatacgatcggccaacgtaagggattgggattaagtggcggcccttggttcgttatccaaaaagacattaagcgaaatatcatttatgtctccaacggctacgacccggaaacgcaatatggcaaggtgattaatatgcaaggtttcgatttcatcacggaagatccatggggagaatttgagggtgagaaagaaatcactttcaagatccgtcataccccggaatttacgcatggctacatccgtcgtatcggagatctatatcgtgtagaatccgacgaaaagattcaaggtatcgctcccggccaatacagtgtaatctacgacaaagaccatcacttatgtctgggcagcggcatgattattgatgagaccaagtaacgcatattcagatttattctaaataaaaaacggtcgcctcaaaaggaagcgaccgtttttatttttctatcttattctattaaatagcatacaaagagctgatagactctccactacatacacgacggatcgcctcagcgaacatgtcagcgacagataatacctttactttctcgcatttcttagcgtaaggaatagaatccgtaaagatcatttccgctaaagcggactgatctacacgagtagaagccggatcagacatcacagcgtggctggcgatagcacgaacagacttagcgccattctccaacatcaagttcgcggctttcgtaattgttccggccgtatccaccatgtcatcaaccaaaaggacatccaagcccgtcacatcaccgataatacgcatctcggccacctcattggcacgcaaacgagatttgtggcaaatgaccatcggcaagcctaaatacttagaatagctgctggcacgtttcgtaccaccaacatccggagtcgcgatacacaagttatccaaaggcaaagacgtcttgatataatccaagaatacggaagaagcatataagtgatccaccggaacattaaagaatccttggatctgatccgcatgaaggtccatcgtaatcaaacgattgatacctgccgtactcaacatatcagcgatcaacttagcgccaatagaaacacgaggcttatcctttctatcctgacgagcccaaccgaagtaagggactacagcgatgattgaatgtgcggaagcacgtttagccgcgtcaatcatcagaagcaactccatcagattgtctgaattagggaatgtagattgtactaagaatacatctctaccgcggatagactcttcataagaaacagagaactcaccatcggcaaagtgctggatattcatctgtcccagaggacaacctaaactgttgcaaattttctctgcaagataccgggagttcgttcccgaaaacaccaagaaaggagtttgtgcactcattattccgaatatttatcttaaagtgaatagatttaaattgtgccgcaaaagtacaaaacttatttacaataacctctttatatttggaaaactttctatatttgcaaccgcaatgatgaagtatttactctatttcttcgtattggtaagtgtatttctgacttcgggttcttcatcaactcccgagaaccaacagaaatacaacgatatttacaccatgtactctccgaatgaagacaagacggaatacaatatcccccaagcagatatcgaacgatacgaaaaagagctatacaacggaaaacaaagctataagatggaagatggctatatcagggcttcactattccgcaacatctccacatcaaaaaactcaaggacaaacctatcctcatccgcggaaaggatcgtacggtttataaaaactcaatatcctaaagaaagacaaacattcatttcattttgtataaatccccttaagttctcctatgggtactatatctatactctaagacgtattctcatttaaactctctttcccccttatttccatcaaaaaagtagaagatagcactttaatgtctgcattctcactattcttattttctagatttctcaaagggaatagaataaacatctattttgttttcttattgggtcatataggatagttcttatcaattaataatcaatctaaaatggaatttttattagacttcatcttacatatcgatcagcatatgatcgagatcgtacaagaatatcatacttgggcctacgcgatattattcctaatcattttttgtgaaacgggattggtagccaccccattcttgcccggggattccctcttgttcgtcgccggagcgataacagcgttacccggtatgcctttagagataaatcttttagccttgatattattcgcggcggcagtattgggagactcctgtaattatatgataggtcatttttttggtcgtaaactatttaacaatcccaactccaagatattcaagaaaagccatttggacaaaacgcatgagttctacaaaaaatatggaggcaaaaccataatcatcgcccgattcgtaccgattgtccgtactttcgctccctttgtagccggaatgggtaaaatgcactattactatttcatgatctacaacctgataggcggcgctttctgggtactgcttttctgctatgcaggatactttttcggagatcttcctttcgtacagcagaacctcaagctattgatcatagcaattatattcatatccatacttcctgccgtaatagaggtagtacgggcaaaactaaaagcacggaaaagatgatgttattgatggaataaacagttccgccaaacgtattaccatctataacccacgccccatctctgatagcggagtaccacgcatacgattacaggggctattatcggagttggtgcgaccaaacgtttctcagccgttcgttggggagtaactcaaagcttgatggctgcatgggttcttacgatcccgggaagtgggcttttagcggctggcatttattatacggcttcccttcttttcatttaaatcaaaggaaaaagtcacctagcttcattgggcaagtatgttaagttactttgccatttcacttaagttacttgcccgatgaagctagatgtcccgtatcaaccacctaactccaccaacgaattatctatacagcacacctaaacttttcaagaaagctcttatttatggagaaaagagaactttagcatcttaccggaataagccgggagtttcacttgataaggataagcgtctgttagcgtactgatagtcgtttccccggttaacaagtcggtcaattcagccggtttgttatcctcaaaatcaagagccttgaatgcctcgaccgggatatttacccatacacattggtcggcacggtcgaaattcacgaccaccagaagtacctcgttcttccatttgcgcaagaacgcatactgacggttcggattgaaataaggattaccggagttcgcgtacatcaaatcataaaacgctccctcgacaataaccggctcggatcgtaccacattcaataacttagcgtacatctcacgcaacgagcgttctgccggcgttaatttagccccatcaaagagtccattattattccagttccgcaaactctcgacgctccaataatcgaagatggtcgtacggccatcacgtccactgaaaccttcagcgtccattcctctttcgccaagttcctgaccgctatagatcataaccggattcgtattcatggctgcggagacaatcatgcccggaatacccggacgagcatcccccgcaaagaaatcagaagcgacacgctgttcatcgtgattctccaagaaattcaacatatttttctggataccctccaacgattgccaacaatgcgatatattactagccggagcctgtccgcacatcaccgcacgaaccgtatcataaagaccaaccttgtcatacaaataatcaaagtgtcccgtataaatataattcctatactcatccggattatacacctccgctataaagatcacatcacgcaccttcttcacctgaggaatcacccagttccaaaactcgaccgggaccatctccgccatatcacaacgaaaaccatccactcccttatcagcccagaacaacaagatctccaacattttctcccacgtattgggaatggtattgaaatggcaagcaccaccgtgcatataatccacgccgtagttcagcttcaccgtctcataccaatcgttctggcttggataggcatcgaaatgattgttaccggtcaccttcgccggaaactcactataggcaaaatcctcctcacgctgcggatcaaaacgaagcgtcaaggtttgccccggaagataataaaagttattattcacatcaaaagccttggacacattatccgtttgacctaagtcctccacgaaaggttcccgtgcgtccgagaaatattgacgtgctacatggttgggtacaaaatcgataataaccttcatcccagcctcatgcgtacgtttcaccaaatcctcgaactcactcatacggttctggatattatccgccaaatccggatctatatcatagtaatcttttatagcatatggagatccggccttaccttttactacggcagaatggtctttccggatgccaaacatggtgtaatcggtttttgtagcgtgctctatcacccctgtataccatacatgagtaacacctagttctttgattttggataaagccaaaggagtaaaagccgaaaacttacccactccattctcggctaaactaccattcattacaggagatggtcgcagattcccaaaccaacgcgggaatacctgataaattaccatcttgtttttttgttccattgcgttcatctatatataaagtttttgtgggaaagcgctttgtccagacagacgatttgtcacggcatcaggcctttctttcttgccgcgatcgctttcaccaaggtttcatatttattctcatccaacactttctcaaagcaacgggcagcggcggaatagccaatattacaaatcacgtctacattctcaagatcgaatgtcttatataagccaaactcctccgcttctattaagacatcacacatctctcgatcctccagcgtatttgcccggaacatataatgataagagcgctcggcgatatggaatatggtctgcttatatttttgcgggatcaacgggcttacgttcaccccaataatacgctcacattcctcacggatgatggagaccggaaagttgtgaaataatcctccatccacataatgaacgccattgatgactacaggactgaaaataatcgggatactacaagaagctgtcaccgcctcaacaataggaccactcctaaattcatggctttcgccattatccaaatcagtcgcgacaaccaccagaggaatttgcaagtcctcgatgttcttggtccgcaagtgtcgcctcaagaaataacgaaagcgcttactatcgaacaaacccgccttaggaatctgcaactgggcgaattccgagaactcacgtccggtaaaaagctcttggatctccgccgccgaataaccatcggcaaacaaagcgcccattaaagctcccgcgctggtaccgactataatatccggtcttagcgcacattcttccatcattcgaaatacgccgatatgcgcaaaacctttcgctccgcctccgctaagcgccaagcccaacctatagggtttatggtttgtctcttctgccatttatttcttgtctcttaatctggtaacaaatatgctgttttttttaattagaaacattattattagggaaaaagtttccatcctcttttatttttgctacatttacacggaaagcaaaggtgttgtcacattgttttcttaagtataacattaaatctaccatgttatgattacgagtatcttctggattatcccgttagcgtctgtcctagcgctagcattcgcctggttcttcttcaggcaaatgatgaaagagagtgaaggaactgagttgatgaaaaagatcgcctcctttgtacgtgaaggggcgatgtcgtatctgaaacagcaatacaaagtagtcgcctcggttttcgttgtcctagtaatcttattctctattatggcctatggcttccatgttcaaaacgaatgggttccgatcgccttcctgacaggaggtttcttttcaggattagcgggtttcttaggcatgaaaacagcgacttatgcctcggcccgtacagcgaacgcagcccgcacttccttgaataaaggtttacaagtggctttccgaagcggggcggtcatgggcttagtagtcgttgggcttggattgctggatatctcattctggtatatcctgttaaatgctttcatcccagacgaggctttggacccgacccataaactcaccattatcacgacaaccatgcttacattcggaatgggtgcctccacgcaagccttgttcgcacgtgtgggaggaggaatctatacgaaagccgccgatgtcggagcggatttagtaggtaaagttgaggctgggatcccggaggacgatcctcgtaacccggcgacaatcgccgataacgtaggcgacaatgtaggtgacgtcgccggtatgggagccgacctatatgaatcttattgcggttccatcctagcgaccgccgcattgggagccgccgcattcgtttcttccggaagcgtagaattacaatataaggcggttgtcgccccaatgcttatcgccgctgtcggtatcattttatctattattggtattttcgccgtccgtacgaatgagaacgcgacgatcaagcaactactgaaagccttagccataggaacgaacttgagttccgtattgatcgctatctccacgttcgggattctttatgtattaggcatggagaattggttctggatcggttgttccgtgatcgtaggtctgctagtcggaatcgtgatcgggcaagcgacggagtattatacctcccagtcctataagccgacccggctggtttccgaatcggggctgacaggcccggcaacggttattatctccggtctcggactagggatgctctctacggccatcccggtacttgccgtcgtggtcggtattatttgttccttcttgttcgcctccggattcgacttcacgaacgtgggcatgggattatacggaatcggtatagctgccgtaggtatgctatcgaccttaggtattacgttggctacagacgcttacggtcccatagcggataatgccggaggcaacgccgagatgtgtaacctagggaaagaagtccgcaagcgtacagacgcattggattcattaggaaatacgactgccgctacaggtaaaggtttcgctatcggttccgctgcgttaaccggcttggctctgttggcctcttatgtagaagagatcaagatcggtttgctccgtttaggagagactgtcctgaactttaccgatggcaggagtatcgaaatatctaaagcctcattctcggactttatggtatattatgatgttaccttaatgaatcctaaggttttagccggaatgttcctaggttccatgatggcattcatgttctgtggccttacgatgaacgctgtaggacgtgcggccgggcacatggtggaggaagttcgccgtcagttcaaggaaatcaagggtattctgactggagaggcacaaccggattatgcccgttgcgttgagatctcgacgaagggagcgcaacacgaaatggtacttccctccgttttagctattatcgcccccatcttaacgggactcatatttggtgtgacaggcgttgtcggactattgatcggtggattaagcacgggcttcgtattagccgtattcatggcgaacgccggaggagcatgggataacgcaaagaaattcatcgaggaaggaaaccacggcggcaagggtagcgaggcgcataaggcaaccgttgtcggcgatacggttggcgatccgttcaaagacacttccggcccgagtttgaatatccttatcaagttgatgagcatggtagcgatcgtgatggcgggattgacggtggcttggagtttgttttaatagttgaccgttagtagttggcatttgacagttagagaagtaaatcgacaatttaatagagaaaactaaataattgtcaatcattgactgtcaattgtcaactgttttgtatttttgcgtcgtaaaaacataaaacaattcaacaatgtcaatctcacgctttaatgctgtggagaaggcatccaaccgaaaggccgtggaagccgttactcccgaacacaaagtatctgagtactatggcgagaatgtcttcaaccggaaggcaatgcagaaatatctctccaaggaaacgtacaaagccttgacccacgccattgacaatggcacacctatcgaccgggaaatcgccaatcatgtggcagccggcatgcgtatgtgggcactggaaaaaggagtcactcattacacccactggtttcaaccgcttaccgatggcaccgccgagaagcacgacgctttcgtggaacacgatggtaacggtggcatgatcgaggagttcagcggcaaattgcttgtccagcaagaaccggacgcttccagtttcccgaacggtggacttcgtaataccttcgaggcccgcggctactccgcttgggacccctcctctcccgcttttatcgtagatgacacactttgtatcccaaccgtatttatcgcttataccggtgaagcactggattataagaccccgctgatccgctctatcgaagtattgggagaagccgccaaggacgtatatagatatttcgatgaggatgtcaataagataattacttacctaggttgggaacaggaatatttccttgttgacgaggacttgtattccgcccgtccggacctctcactcaccgagcgtaccttgctcggacatgagagcgcgaagaaccaacaattagacgaccattattttggcgctatcccctctcgtgtacaagaattcatgaaagacttggaaaccgaatgctataaactaggtatcccggtaaagacccgccataacgaggtagcccccaaccagttcgagctagctcctatttacgaggaatgtaacctagccaacgaccataaccaattattgatgtcggtcatgaaacgtgtctcccgccgtcataatttccgtgtattattgcacgagaagccatttaacggggtaaacggttccggtaaacactgtaactggtctatgggaacagacaagggggtaaacttattctctccgggtaaagaccgtgaggacaacctacgcttcatcaccttcgtggtgaacactatcatggccgtttataaatacaacgctttattaaaagcgagtatcgcttccgccacgaacgcacaccgcctaggtgcgaacgaggcacctcccgctatcatctccactttcctcggaacgcaaatcagcgagatcttggataagtttgagaatagctctatcgaggacgctatcgaggtagacgataaaaagggtttgcatcttggcttcgggcagatccccgaactgctgttggacaatacggatcgtaaccgtacctctcctttcgctttcaccggaaaccgttttgagttccgtgccccgggttcttccgtgaactgcggatcagccatgttagcgttgaactccgccgtagcctatcaattgcaacaattcaagaaggacgtagaggctttgcaagcggaaggaaaaagcaaggaagtagcgatcttcaaggtgctgaaagcctatatcaaggaatctaagccgatccgcttcgatggaaacggttattcggacgaatggaaagaggaagccgccaagcgaggtctggattgccaaaatagtgttcccttgcaatatgacgcttatcttaaaccggagtcgatcgagatgttcacgtctaccggcgtacttacccagaaagaattggaagcgcgtaatgaggtaaaatgggaagtctatatcaaaaaggtacagatcgaggctcgggtattaggggatttatccttgaaccatatcatcccggtagccgttcgctaccagagcgtattgctggataatatagcgaagttgaaagagacattcggcgatgacccggaattccgcgatatgtcggaagagccccgtcgcttggttcgtaagatagccgggcatatctgtgccgtgaccaagaaagtggatgagatggtagaggcccgcaagaaagcgaaccgcttgaccgatatgcgggaaaaggcgatcgcttaccacgactcggtagccccttatttggatgagatccgtgaccatatcgatgatctggaactgatggtggacaaccagatgtggccgttgccgaagtatagggaactcctgtttatccgataaaaaacaccaatactggcgttgccttgcgccagtatcggcatagcctcacactgatataggcgcagccttacaccgatacaggcataaggctacgcctatactcccgtttaccacttcacataagaagcattcatcaagaagtcataatcatgtttcatcgcttgcaacggtgtcatattataacgctcttgctcaatgaagtaatcctctaatccggctttctccgccacagcgaataaggatttgaagtctacgattccggcgcccatctctgtgctgccctttccatccgcgttcgcgtctttcaagtgccagttggcgaaacgaccgggataacggttcacgtaatcatgacatttaaaaccgccatacactaattgagccgtatcgatctggaaagtaaccagccctttgtccgtattctcgatcatcacgtcgaacgggatcttcccttccagctcatggaattcatccacatggttatggaaagcgaaacgcaacccgttcgccttcgcgatctcaccacatttattaaattgatccgctaaacgcttcacgtccgaaaggctcttgatatctttggagggataacccgcctgaacaatccatttacagcctacctctgccgtatcggcggcattctttttccagaagtcccatcccttggtatcaccctccgccagcaaaccgcttccggtatgggaacctaccatacgggcacccagatccgccagatatttcttcatctcggccggggatttcccgtagaatttgccatcccggtaaccggcggcttccatccgtttataaccgatatccaccaaagccttcatcgtaccgtcaaaatccgtcttcaagtcgtcccggacactatacaactgtacacctatcgctttctctttcttagccaagatagaggcaaagccgttcggtactacactcagcgcagccacagcggcacccgctttcaaaaaattccgtctcgttatcatcatactattctttaagattaacgtcgctaaaggtagcaaaattatttctactttcgcgcacatttaaacaaacgatcatgcaaggaacaaaaaatctgaccgaaggggtcatctcccggcaactattcaatctggcgatgccgatcatgggtacctcatttatccaaatggcctatagcatcaccgacatggcttgggtaggccgattgggaagcgaggccgtagccgctatcggcgccgttggtatccttacttggatgacgaactcgatctcttacttgaataaagtaggctcggaggtgagtgtcgggcaaagtatcggggcgcaaaacgtggaagatgcccgaggattcgcttcccataacctaacgatcgccttgatcctctcgctttgttggggattcttgctattcgtcctcgctcatccgattatcggcttctacaaactggaggaaccgatcgcgttgaacgccgtggaatatttaagaatcgtcgcttccgcattcccatttatcttcctctcggcggcgtttaccgggattcataatgcggcgggattgagtaagattccattttatatcagcggaacaggtcttttactgaatatggtgctagatcctttatttatactcggcttccatttgggcacggcgggcgcggcttgggctacgtggatctcccaagcggtggtttgcggactattcgtctatcagctaaaatgccgcaataaattgttcgggggattccctttctttgtccgtttaaaagaacgctacaccaagcggatcttccaattgggcctgccggtagcgttattaaatacattcttcgcgatcatcaatctttttatggctcgtacagcttccacctacggagggcatatcggtttgatgacgcttacggcaggcggacaaatggaggcgatcgcatggaacacctcacaaggcttcagtacggccctctccgctttcaccgcccagaactacgccgcacacaagaaagaacgtatcctgaccgcttatcatacgacgcttaaaatgacttcgatcatcggcgtgctctgtaccttgctattcgtcttttacggtagcgaggtcttctcactgatcgtgccggagcaagccgcttacgaggctggcggcatattcctccggatcgatggctattcgatgatcctcatgatgttggaaattaccacgcaaggcatgttctacggtaccggccgaacagttccaccggcgatcatcagcatctcgtgtaacaccttacgcatacctttggccatcgggctggcggcagcgggactgggtattacgggtgtttggtgggcgatcagcctttccagcatgctaaaaggtatcgtcgctttcatctggttcagtatcttacagaagaagatcttgtaagcggaacaattcttaccgattttccgtacattcgcgattaaaatgacattcaattaaaaaaacaacctatatggataacaaattcaaaccggaaaccctgtgcgtacaggccggttggcaacccaagaaaggagaaccccgtgtcctcccgatctatcaaagcacgacattcaagtatgagacgagcgagcagatggctaaattgttcgatttggaggaaagcggctatttctatacccgccttcaaaacccgacaaacgaggctgtagccgccaagatcgcagcgttggaaggtggcgtggccgccatgctgacctcatccggacaggccgctagctttttcgctttcttcaatatttgcgaggctggcgatcatatcgtaagcgctaccagcatttatggaggtacttataatctactggccgttaccttgaagaagctgggaatcgaatgcacgttcgtagatcaagacgcgagcgaggaagagatctccaaggcgttccgcccgaatacgaaggcgatgttcggcgagatgatctccaatccgggcgttatggtattggacgtggagaagttcgcccgcatcgcccataatcatggcgtacccttgatcgtcgataatacgttcgccacgccgatcaattgccgtccgttcgaatggggagcggacatcgtcacgcactccacgaccaaatatatggacggccatgccacgagcgtaggcggttgtatcgtggacagcggcaatttcgattgggaagcgcatgccgagaagttcccgggactttgccaaccggacccttcttaccacggattgacctataccaaggcattcgggaaattagcgttcatcacgaaagcgactagccaactgatgcgtgaccttggagcgatccaatccccgcaaaacgcattcctattgaatctgggattggagaccttgcatcttcgtgtaccgcagcattgcaaaaacgccttggcggtagcgcagtggctacagaaatgtgataaggtagcttgggttcattatccggaattggaaggcaatccgtaccatgaactcgccaagaagtatctaccgaatggctcttgcggtgtattatccttcggattgaaaggtggacgtgaggtggcgatcaagtttatggatagcttgaaactcgccgctatcgtaactcacgtagcggatgcccgtacttgcgtgcttcacccggccagtcatacgcaccgccagttgagcgatgagcaattgatagaggctggcgtggctccggacttaatccgcttctctgtaggtatcgagaacgccgatgatatcatcgccgatattgagcaagcgctgaataaataagacatctgtgccatgctgatgaaacgcttgtgccatcagcgtggcacgcttgtgccatcagtgtggcacgcctgtgccatcagcatggcacacctgcatctacagcacggtactgctataagttcctagataggcaggaatctccccagacgcgccacccaatttgtcgtaatcctccctaggctcgttaccggatgttcctcacgcaacaaatcctcacggaactcacgaagaataagccaatccgcctgtttcacccaatgccggaagaccggattctccacatgactttccgaaatggataataacacgtccagatcaaaacaatcagcgacaacgcctgcgccagacaaagaggcatcgtaagcattgcaagcttgctcaatatgtgtaggaaccatcaatacaggtttattcagatacatcgcctcacatacggattcgaacccggcggtcgtagcataagccttcgcccccgacatataacgtagaaacaacgtatcatccagctgatggaaagaaaggcaatcgtctattttcacctcggctcgctgatctttcttatcccaaaagaaatgcatcggaaccgaaggatgacgggaatgccaagaacggatctcctcactaaacccgctattcaacaaataaccatgcaaataactgccgttcgagggaaccgcatccaagacttcttgccttaataaaggaggaaccacgactattcctcccaacggcgcctcacgcatcttccggaaagacaaggctaattttttgacggagcctatcgccgttaatctcgtaaaaaatcgtagcgacgccaacgacaatgtgctctgcttcgggaaaacgaagtccggatgcaagaatagatattgatgggcgatacataccatcgttgctttcggacggagaatcaagtaagtcagccccgtcaatagctcgtagaaattcacgacaacatccgcatccgtctgccgaatcatccggtcgatataacggatacttcccatgtatttatgcagacgcaatacattatataatacgctacgcatcaaactcacttgtttattcttagccgtcggtaaaaaattcggactctcaaacggatataccggcgattgtatcttattcaagaagaaatccggcaaacggcgggccgggctttttcctaccaacacaccaacgatctcatgtccttcggccatcaatttctggcgtaaggataacgcttgggtcaagtgcccacgtccctcaccttgtatgataaacagaattttcatacggcatccgcatatagttgtacattattatatgtaacaatatcccactctccttgttcatcctccacgagagcggtcatgctttccacccaatcgccggaatttagataatgcacattaccataccatacgctcgccgcttgatgaatatggccgcaaataatcccatccaaatgcttggcctccgctaagcgtaccagctctttctcaaactccgagatataagagaccgcacttttcacccggtgtttcacctcttgggataaagagaaataaggttttccttgccgctctctacgatgattgtaaaccttattcaaccacaataaaaaagtataccccacatccccaagcatggcaagccaacgcatatgggtcgtaaccgtatcgaaaatatcgccatgtgtcacgaaatagcgttttccttgtctcgtcttcagcaaataatcctttacgatcgatatattggagaacttaaaaggagccaagctgtcgagaaaatcatcatggttccccactacatagataatctccgtaccccttttctccatcatcttcatcaataccttaaagaaatcggtatgcttttgtttccagcgtttaccggatttcttcaattgccagccatcgatgatatcaccattcaaaatcaatcgatcgcaatctacgtgcttgagaaaacgggtgacctcctccgtccgggaatgttccgatcccaaatggatatcagagaggacaatagtcggatagtactttcttaatatcatctttttcttgtttaagatgatacaaaagaacactttcggtattacaagttcacgacaacctaatgaaaaagacataacaaaaaggccagctcttcacaaagccggccttttctcgtttaactttaaatattaaaaaattatgatgacattttactttacctattcttctgattgagtagcctcgtaagcctttaacaacttctcttgtacatcggcaggaactaactcgtaactagcgaacttcatcgtaaaggaagcacgtccgcccgtaatggagcttagtgaagtagaatagttagacatctctttcaaaggaactttcgccaatagtttctcaaatcccttctcgctattcatacccataatcaaggcgcggcgtccttgcaagtcactcatcacatctcccagataatcggcaggaacggaaacctcgacatcgtaaataggctccaagatcttagggccagcctccttgaaagcggtactgaacgcattgcgtccggcaagcatgaaagagatttcattactgtctaccgggtgcatcttaccatcgtatacgcaaatacgcacatcgcgagcatacgaacccgtcaacggcccttgctccatacgagccatgatacctttcaaaatagctggcaagaaacgagcgtcgatagcaccaccaacgatacagtttacgaacacgactttaccaccccaatccaaatcaattatttgagtatcacgaacattcatcttatactcctgtccgccgaaacggtaggtatccggagcaggcataccttcataataaggctcgataatcaagtgaacttcaccgaactggcctgcgccaccggattgtttcttatgacggtaatccgcacgagccgctttcgtaatcgtctcacgatacgggatcttcggctccagatattcgatcggcaatttatcattattctcgattctccatttcaatgtacgaagatggaactcaccttgaccggaaacgattgtctgcttcaattccttggactgctcgattacccatgtcgggtcttcctcacgcatacgtatcaagatttccatcatcttctcggcgtcagcctcattcaccggcttgatagcacgacgatatttcggatccggatatttaatgaagtcgaaacgataatcacaaccctttccgttcaatgtattaccacggcgaacatcctttaacttaacggtcgctccaatatcacccgccaccatttccgtaaccggggtacgagtttgtccggctaccgcaaataactgtgcgatacgctccttggaaccacgatcggcattcatcaaatcgtcaccttcttttacttttcctgatatcactttaaaataggaaacctgaccaatatgaggttccacggtagtcttgaagaagaacaagctagtaggaccattcgagtccggagtcacctctacgccttccgtagtaatcagacgaggcatcttgtctgtacaaggaaccacgttacccaagaactccaacgtacgacgaacacacatatcacgaccggcacatacgcagaataccgggaacataccgcgagtaaccaagcccgcacggataccggcacgcatatcatcctcgctcaaggcaccttcctcaaagaatttctccatcaacatatcgtcgttctcagcggcggcttccaccaaggcttgatgcaactccatcgccttatccatttcctcggcggggatttccaatacatcaggaactccaccttccggtttccaacgatacatcttcatttttaatacatccaccacggcattgaaagaagagccgcagctaatcggatattggataggaacgatcttactgccccaacggtctttcaactgggcgatagttccctcatagtcggctttatcattatcaagctgattgacaacgaaaatcaccggtttatgaaattgttcagtataccggaactggttaacggttccaacctcaacaccgtactgggcattcaataccatcagtgccgtatccgtgacattcagagcggaaacagctcctcccacgaaatcatccgaacccggacaatcgatgaaattcagcttccgatcctgccattctacactgaaaacggttgagaacactgagtatccatactctttctcaaccgggaaataatcggacaccgtatttcctgcctcaacggagccgcgacgttttataactccaccctcgtaaagcatagcttcagcgagagtggttttcccagagcccgaacttcccaagatagagatgttcttaatttcatttgtttggtatactttcatgatatcaggatttatttgagtttaacaatacgtttatttggcgtgaatcactttcacgagggcgcaaattagagattgtaaaggaaaaaagcaattatcgcccggtgtttgagaactatgttgtgcagcagcaaggttttttggaattaaaatcatatctttgtgtaaagatataattgtgtccatacagatggcaggcttatacatccacgttcctttttgcgccaagcggtgtttatactgtgactttttttccaatacggagatgaagtataaagagccgtatataaacgcacttataaaagagatggaattgcggaagggatatataggaaacgaagcattagaaaccatttacttcgggggaggcactccctctcaattagacgagaaggatttcggtaagatattcgaagccatctatcgtctttttgatgtagccgagcaagcggagattaccttagaggcgaatccggatgacatgaaacgagaatatgtatcgcttctccgtaattatccttttaaccgggtcagcatgggtgtacagagttttcatccggaagatttgcgttttctgaatcgtcgccatgaccgggaacaagcgattaaagcagtagaactatgcaaggaatatgggattacaaatatcagtatcgatttgatctacggacttcctaaccaaacgaagcaagcatgggaagagaatttgcgacaagcgatccggctggatgttccccatctttccgcttaccacctcatttacgaagaaggtaccgcactttacaaattaatggaagcgggaaaagtaactcccgtagacgaggagttaagcgtctcgttcttttccacattaatagaccggttggcagaagcaggctatttgcattacgagatctccaatttcgcccgtcccggattcttctccaagcacaatagctcctactggaccggaaagaaatatctggggctcggtccttccgcccattcttataacggaatagaccgggaatggaatccatcttctctacctatatatatagaaggtatagaaaatgggcatccgacaatagaatccgaggatttagacctatgcacccggtacaacgacttcatcatcaccggccttcgaaccatgtggggagtctctttcgctgatatccagacaaaatttggcaggaagctcctttcttattgtcaaaagcaagctcaaccccatatcaaccaaggtctcttattacaaaccggtgacaaattgattttatccaagtcaggaatcttcgtttccgacggaatcatgagtgatctactttgggtataaaaattaacaaaaccaccactttccccaacaaacctgttagttaaaagtacatttcctgcacattttcacgatttttgagaaataaaacgacgcatattaaaaaactattacatatatttgcagcatcaaaaacagcaaacagtgccatatttgtatataatatcaggttgcaacggagcaggaaaaacaacagcttccttcactattttaccagaaatgctaaaatgtagggagtttgttaactcagacgagatagccaagggactttccccttttaatgcagacagtatagccgtcgccgttgaagctagtcgtattatgtataagcggataaaggaactcatcggtgctggtgagactttcgcaatggaaactacgctggccacccgttcagtcgcaaacctgatacgggaagcacaaagggaaggttattatgttacattgctttacttctggctgaatacgccggatctagccgtggaacgtgtgaaaatgagggtagccgccggaggtcacaatattccggaagcaacgatacggcgtcggtatgaggccggtatccacaatttatttgagctataccttcctattagtgactattggatgataactgataattcgatgtctcccatggaagtgatcgccaagggattcaagaatgataaaagggaagtgtataatctagatatttttacaaaacttgaacatcatgaatgagcaagaagttagagaattcgaagagaatatagtaaaaggtgcaaatatagcttttcagcgtttggtgaatcagaagaagaaggaagacggagagttggtattctctcgtaacggtcatatcttcagagtcaaagctgttgatcttgacaagatttattaagttatagatataaatatacaaaaagaggagacgtatctttaaaagatacgtctcctttttttgtatttatagagaagtaagttaacttacttctctatcttgagaattccatctcgttcaataaataaccggctccggcatatttatcgattacgaataggacataacggatatctacgataatactgcgttgataatcgggcagatattggatatcccctcctactccttcccagttacggtcgaaattgataccgattaactctccttgtccattcaataccggactaccggagttccctccggttgtatgggtcgtagcacagaaggcaaccggcattttaccgttaggcatcttataagggccaaagtctcctgcttgatataattccttcaaacgagcagaaaccacaaattcccaattcgtagaatcctccttctccatgacgccgtctaaagtggtttgatgaccataataatcgcaatcacgaggactgtaacctttcacctgcccataagtcagacgaagcgtagagttcgcatccggaaaactagctaagtctccatacatcgctaaaagtcctttcacatacgcacgatgggcgatcgcatatccggcatcaaaatcagccaaggccttatctaacgcccttttctcatcctttacggattgcgcaaacagaatcatcggatcttctctcaaagttttgacagacggatgctccttgaacgcattgaagttcttctcgctaccatagatcgatttatcaaacagataatcaacgaatttatccacatcccccttaaacttgctatcgattacggagaaataagcgggctgcgacttcggagcgaccaaacgcctatattcctttaacatgactttcgctatcttcttatcaaccatcggcgcataatccttatcagcgaaacggtggaaagccctctccaattgagtgacctgtttttgctgctcggaacgatctttcccctccaaagcctcacaaacagtcccgatatcggtcggaactttggagaactcgatgccacggctcaatgcctcatccaacatccaactacggaaacgcaaatccttacgatcattaacgatctgctccaatgtcagaagcgcttccggataagcaggctcacacatcttcttcgaccaagcgatcaaacgatcctgctcatcgtttttcatctgctcaaaattacgtttgttgatcgcccagttactaccgatcgcattcttataagcgttcgtagaccccgcatacttactagcgtattgaatccggacttgcggatctttcaacatttcttccagcatcgcctcttgacggagattacggatattgatacgtaccgcattatctatatcccgacgctcggctacctcccatgaggtatagtatttattggtacgaccggggaaccccatgatcatagcataatcgttctcctccacaccttttatagaaagcttcagccagcgtttcggacgaagcgggacattggtttccgaataaggcaccggatttccgttcgcatcagcatacacacggaaaagagagaagtctccggtatggcgaggccacatccagttatccgtatccgccccgaacttaccgatagaggaagggggagcaccgactaaacggacatccgaatagaccttcttggtaaacatatagtacttattacctccataaaaagccttgatctcgacttccgtaccggggttatcctgtaagaacttctcacctactttcgctttagcgaggccattcaagtacttagcggacaagaattccatgctgttcggatccgtgatctttttcagttccgtcctcacataatccgtcacgtcatcgatcttatcgataaaagtaaccgtcaatcccggattcggaagctccttatcacgagacatcgcccaaaagccgtccgtcagataatcatgttccaaggtactatgccgttggatgctactataaccacaatgatgattcgtcagcaccaacccgtccggagagatcatctcgcccgtacaaccaccgccaaaacgaaccacggcatctttcagagaaggagcctcagcgctatacacttcctgatcgcttaatcgcagaccaagggcctgcatctccgcaaacttttgttgcttcaataaagggagcagccacatgccctcatcggccaagaccggaaacgccaatatagcggccgctacagataaaaagagtttcttcatgcatttgaactattaaaaggatgttttgtcaacattgaattataataacggcgatctccacttacctccttacccagccaagccggtttctcaaaaggctcgtcctctgacgataactcgatctccgcaaggatcaacccttcattcgctccgtggaaaacatcgacttcccacgtatggctacctctgggaaccagataacgaaccttgtcgatcgcacccggctcgcaaagttccaacaaccgctcggcatccaccagaggaatcttttgttcgaactcataacggctcaagcctttctcatccgaagcgcctttgatcgttaggaatccctcctctccccggatacgaatacgaaccgtacgtccgggctgtgagcaaatatatccctgcacgatacgggtggagctaacagcctccggtaagaaatcaccggagaccaagaatttccgttctatctcaatggccatgtttcgaggtatcagccttaatcgttaccatcgtcgcaccaaagccatattcgcggaaagaagcgtcttgaaaataatgttgcttataatgggtcttcaaatccttctcgatcgccttacgcagtacaccatcgccttttccatggataaagacaatcttctgtccgttattaagagcgtactgatccatcacctcacggaattttcccaactggtacgtcagcatatccgcattgctcaatccattcgtattatccaacaattcggttatatgcaaatcgatctcaaggatagcgctattcgtcggcttctttttcacgatttgccggggaaccctacgttcctcacgaaccttttgctgcatagcttccttcaactccgccgcagagaccaatagttctctctcgggcaagtcattgcggataatcggataaatcaaggcatcctcctcaaagaaatcattctccataaagcagtgaagcttgtagaacttaaccgtatccaagcgcaactctacagatacggcgtttttcaacgaatagggtttatccttcttgaaagcgatcagttgcacgcagatcctttccagatcattcaactccggcttaccgaactcctctaggaatattttcgtattcggctcaataatcccgttataacgacttgtccagctattattcgttcggttcatataattgaagaacaaatagtaattgctatcattcacgaaatacgtctcatagccacattgctgaaacgccttcggatcgaccgggagataagccagatacacattcagacgctctccctccggtgtctcctcgaccttttcctctttgggttcaggcttctttggggaaggagtctctaccggagcctgtactttcgggcgattcgagctatgcacttgcatatcattgcccccaaccacgacacattccttgatcaaggcaggaacctcaaacccatcctcatcctcaaccaacacttggtcctttccacggaatccacgtacgactccacctcccacactattcaggaagcgaactttatcacctatttgaatactcatattctataccttattatattatgcgcacaaaattagggaataatccgcgaatccgaaacctatttactacttttgcactcggaatccgtacaaacggatgtttttttaacaggacagaagaagtaatgaagacacaagaaatacgtatcgaagattataactattcgttaccggacgaacgaatcgcgaagtttccattgcctaaaagggatgagtccaaacttttactctaccgtaacggggaaataagcgaaagtatctttaagcatatcacggattatcttccccaaaacagcttgatggtattcaataatacccgggtcatacaagcccgcctacttttccagaaagagaccggcgcacgcatcgagattttctgcttagagcccatcgagcctcatgattacgccttgatttttcaagagacccgacgctgtagctggacttgcttggttggcaaccttaagaaatggaaagaaggcactttatccaaaacgatcttcattaaggatcaaccggtcgtgctgacagcggataagaaaaagtctcatggtgacacacatttgatcgaattcacatgggataacgagacttatacattcgccgatatcttggatgccgccggggtcttgccgattcctccttatttacacagagaaacagagaagagcgacctacagacctatcaaacggtttattctaagataaaaggctccgtcgccgcaccgaccgccggacttcatttcacttcggaagtacttgccgatatagatgctcggggcatcgggcgggaagaagtcaccttgcatgtcggagcgggtacctttaaaccggtaaaaagcgacacgatcgaagggcacgagatgcacacggaatttatctccgtccgccgcagttccatcgaacgtatcaaaagtaaccttggaaatatcatcgccgtaggaacgacttccgtacggaccttggaaagtctctattacatgggcgtgatcctagataataaccccgaagcgacttccgaagatctcgtcgtaaaacaatggatgccttacgacatgaataacaaccggctgacagcggagcgttcccttcaaaacatcctcgattatctggataagcatgatgcggatacgctggtaacggctacacaaatcatcatcgccccgggctatgagttcaagatcgtaaaaggaatcgtcaccaacttccaccagcccaaaagcaccttgctcttgctgatctccgctttcgtaaaaggaaactggaaatccatctatgagtatgccttagagcacgatttcaggtttctgagttatggggatagttccttgttattgtaacagacatacaataagatcccatacaattcgttatatttgcacgaatatattccagattgaatgaaagcacattttactatatatgttttatttttgcttatcgtatcttccttgtattcctgcaaatcggcgaagttgagcgatgccgaggagaagcagcgtatcggggaatactatgaggcagccgccatttatcgtaaagtttacacgaaaacatccccgaagaaaagggatttgcgcggctatatcgcttaccgtatggccgaatgtaaccggttgatcaacaatacggcgaaagcgactagtgcctatatgaacgccatccgctatgattaccccgatagtaccgtctacctacgcatgggacagatgttacagaagaccggacgttatccggaagcgatcaagaactacgatatctatatggagaacgatcctagcaatttattagccatcaacggcatacaaggatgcgagttagctcccggatggaaaaagaaccctacccgctacgaggtaagacgcatggataaattcaattcccgccggggagaattcagtccgatgctggccggagataaatacgaccaactatacttcgcttcttcccgctcgaaagacaaagacgcaaaagttagcgccatcaccgggcaaaataacaataacctcttccttgtcaagcaagacgagaaaggggcttggctagctcccgtagagcttgaagacgaggtgaatacggaatacgacgaaggaaccccctctttctcccccgatggaaacacgatgtattatacctattgcgcccaagatccggaaggccctcgtaccgccgagatttacatatctacccgaagcagcgccaaatggggaaaaggaacccgtgcgacgatcgtaaaagactcggttaccgccctcggccatccttccatctcgccggacggcaaatacttgtatttcgtatccgacgccgtgggcggtttcggtggcaaggatattttccgtgcccgggtagcgggaaacgatttcggcccgatggagaacctaggagaagagatcaacaccccgggagacgagatgttcccgtatgtccgggattccgtcaccctttatttcgcgtccaacggacatccgggaatgggcggtctcgatctgttcaaggccacgcaagacagtacagggaagtggaatgtcgagaacctaggcgctcccatcaactctatggcagacgatttcggtatcaccttcgccggaaaagaggaacggggcttcttctgctccaaccgcaacgacgcacggggctatgaccatatatattcctttgaacggcctacgatcaccatcttcatcgaaggaatcgtaaacgatgtcgatgaatatccgatcgaggacgctaccgtacgcatcgtcggaaaagacggactgaacgtgaaagtcccggtcaagaaagacggaacctatcgtgtcgagttggaacgggacatccgttatgtcatgatggccagcgcccgtggttacctcaaccagaattacgagttgcataccggccccgaggagaaaaacgagacgtatatcgtggatttctttctctctccgatcagcaagccggttgttatcgataacattttctacgatttcgataaagcgacccttcgtccggaatccaagaaagctttggacgagatgatcaagatgctgaacgataacccgaacgtaacgatcgaactgggtgcccacacggaccggaaaggtacggaccagtataacgagcgtttggctcaacgccgtgcgcaatcggtcgtggattacctaatagcgggaggtatcgaggcggctcgtctggaagcgaaaggatatggagaaagcgttcccaagacgatcaacaagaagatggctaaacaattcgatttcttgaaagaaggcgatgtgcttaccgaggaattcatccttgccctgccgccggaacagcaagagatcgccgaccagatcaaccgcagaacggaattcaaggtcttacgtacaaactataacttattttgagggagcaaagagcgtgatctccttaaaagagactggccaatcgatcgcactcatcagcacatcgaaggacaggcgttgctgataagagaccgaggactcccttgaatacaagtcatgagctaccaaaccgatcatcatcttaaccttataatgcaattccttggatagtaccaagcaggcaagtacactcaaatctctcgcttcttcccaatcccgatccgcaaaacacatctccctttgaagtgccggataatgacgagtccgcatgatcagatccggatcacggacctcacacgcaccttccactacatccaataatatacgacagacagccaaacgttgctttttaattacctccatatacgtttccctcaaaccggaccgttcaccttgttcggtatttctatatgctacaaaaaagaagcgtgggaactgttaatctactattcgaaactgaggcatcgccaaacacccatcggacaaataataaacaacagcccacgccttattacgtatactattaggcagtatatataacaagcgtgagcgtttagttgcctattatctctgtccgacttgaaacttggcgattttcagttccaaagataatatcttaaacgcttatcgtaatcacactttgattcataaacccttgaatttccacaagagtttactttatcgatacaaatataacgctttttctcatacatcatatggatttatttttctcttttaaaatctattgggaaaagatagcgtatactctctagcgataaattcttccactataaacaagatgcttccgtgagtaaaaaagagaggcgcatatacatcctatttatgtatatacgcctcaccattatgtggatatttccaaatccggaactttcttccttatttactctaccgagaacttataaatacactcactcgtatatttctcgcccggacgaagcactacgctcgggaatgccggctgattcgggctatccgggtaatgttgagtctccagacatagagcgccacgatgcgggtaaaccacacctaacttgcctttatcacccgctttcgtcattgagttaccggcatagaattgaagacccggctcgttggtgtaaacttccataacgataccgcttgtcggagatacaactttagcggctaccttattgatatcgccggcggcgttcaatatccagttatgatcgtaaccaccaccgtaaaccaattgcgtaaacggattgtcgatatcagcgcctaccactaccggtttgcgaagatccatcggcgtgccttccacgggttcgataccggtcgggatcaaagtctcgtccaccggattatatgtatccgcgtcgatcatgatcgtatgatccatgatttgcgagccgggaacaccggaaaggttgaaataactatggtttgtcaaattcacgacagtaggtttatccgtcgtagcctcgtacttaatatcaacggcgttatcatccgtcagcttatagatcaccttgatatccagattaccggggaaacctgcctcaccgtctttcgatagataagtcaactccaaggtttggtcatcgatctgtttcgcgtcccaaactaccgcgtgatatcctttcggacctccatgcaagcaatgcccgttattattctgcggaagttgatactccgttccgtccaacgtaaacttaccattcgcgatacggttgccataacgtccgatcaaggcgccataattcatgtccgggttcgccacgtattgcgcgatattatcgtaacccagcaccacgtccgtcatcttgccgctcttatcgggcaccatcacggccaccaagcgtccgccccaattcgtcacgcaagcctcagcccctttcttattcttcaacacatacaaagcagtcggcttaccatctacctcagacacgaagtccgacttcatcaaaccggagagagtagcctcttccgtagccgcccccttctcattcttacctccgcatgacaataacatacacattgccatgaccgcaaaacaaagttttttcatctctttcctttaaaattaataaatgttattcttcgggcaaagatacgcattctatccacatgaggtccaatatccttacgcattttctcgggaatccttaccgatttctactcgaagcactacaccattcctcttgatatcttaaccatccatcaattggtagatgatcatgcaacagccgttggacgatcatgcaacagttggtagatgatcgtccaacagctgataaataagctagatcttcatacaaatcccctaatacctcccgaagaaaccgccaaggagacccgaagaaaccggtagaagactcgtactttacaaatggcatcatggaattttttaatacctttgcaaccggtctctatcacggcgaaagtatcaacgcttgccaaaaacaaagagaggccaagtgtcatcatattaaacacattataattttctatgagcaaacaactttatttcatacaagaatcattcactgatcaagagcttgagatattaaacaaatatttcaccaatacggataagcctgtttttggccttattaatttacccgatgtcgtaaaaggagcgcttttcgctagatatagtcgatctaataaatcattaagaaggttatttttagatgagttctatacccattcaacgaaacttacgacagatagtatgcctgttgccggtatggaaagagcctcttccctgtatgacaaaatgatcttggactttggcgatgactctgtcgcccaactgggtggtgcgcacatagcttgcgagcaagtatccaatatcttgacaaaaatcatagaaaaaggacgtatagcttcctatttagagcagagtacacgatatgtgtactataataaaaagataaacggacaatatcactatgttatccccctgagatagccggttctccattagaaagcctgtataaggaatatatggactttctatttgacacatatacagagatcctcgaagaacttaccccaatattaaagaagaaatacccgcaaggagaaaaacagacagacagggcttgggaagcgattatcagggcaaaagcatgtgacatcgtcagaggtttattacccgcgtccacaaggtctaaccttggggtgtacgcgaatggacaagcctttgaatacatgttggttaaaatgtacgcaagcgataatgccgaggtcatacaatatgccgatatgatattgcacgaactaaggaagataatacccgcctttttaaccagagtcgatctagagaacagaggtaaactttggagtcaatatatcaaagatattcattcggatatgaatggcgtagtgaaaagtctattaaaaaaagaaaccgttgcgcttccaatcagacacacacagaatgaggtcaatctgatcgcatgggataaagacggtctggataaaataatacagtccatattattcgaatatacatttgaatcagaaaaggatatacagaagagaatcgagacattcactgaagaagaaaaacgggacatcctgaaaaagtattgtggcaaccggcagaacaggagacataaaccgggaagagccttggagacaatatcctataaattcgaggttctatcggattacggagcattcagagacctgcaacgacacaggatgctgactttagaatggcaaaagttatcacctcgcaacgggtacataatccctattgagctagaagacttgcctcgattgaagaagctttatgagaatgccttgatcaaatccgaaggtatctatgagaaaataaacgacgcgttcggagaagaagtcgcccaatacgtcattcctttcgcataccgggtacggtatgagatatgtatgaatctaagggaagcgacccacttcatcgaattaagatcgcaaaagcaaggtcattattcttaccgtaaggtttgtatcgatatgcacgatttaatcattaataaagcaaaacatgattttgtcgatgattgcatgaaattcgtggataagaacttctacgacttgtcaagggaagatgcggaaaataaaaaagatagaaagctgtaggatatggaaacggataatttgtatataaacaacgccctagactggttgaagcgagcagtcgactcactggtcagccacaaaagaacggatgaaggtacggggttcgtccgctcttccaaacaaataataccggaacaaaaagaaggtatcttctataccgctaccttccaagcctactccgccttgttggaaagcgcggagacttataaggcggaagcattcgggctaaaagaaatgacccttgaactgacccatatatttacccccgatatatttgcgaaaaaagatcaatactcaaccaacaatggtagccgctccatcatcttgctggaacaaatattaaaggtgatggtttatctccagaagtataaacatacgattggcgaagacatcataaatgcggcaaaagaagccattgatatagaaactgccaaaacggacatcctatccaataacgccaacgatgaatactattacccggaggcaggtaggtcaccttggttcctgctcagcttactcaattgccagaaatacatcgaaaccatatatggggatgccaacggaatcataaaaataccatccgtggacactttgatagatagccatatcaattaccacatggctcgctataacgtaaaagaattatccttcgaccccatctcattggtaatcgcactttgctgtaaaataacaagagatcccggttttaagacctcccccttttgcatctcatgccttgaggcgattgtcaaattacaacataacgatggctgctggcccacgggagctacgatatcgttcgatgattccggagatgttattcaacaagctagcatccaaatcgcgtcacaactggccgaggccatcattgactataaattcttagtcgattgcaatgacaacgtagagcaagtcttagatattattatcccttctttcagaaaattattcaactatataaccgccacgttcgagaagcttgacaatccgtgcgtatatggctggagcagcgaccgaatcaagctcaaaggctatacggaaacatggatcacggcttatacatgccgttttttgtataaatattggcttgctgaaaaagcgtacgcacgcataaaagcattaaaaaggctaggcgtgacaaactatgtctatgacgaacaaaatacaataaaagagatcaaacgctggaatgatgaaatcatcgaaccggatcacatcttaaaacctaaagaaacaatcgatgggattatccgaccgattataggaaataaggaaaaaggctgtttgcttctttctccccaaaaagacaatatctccttcattatatgtggtcccccgggcagcgggaaaacctatatcgtgaagcaaatggctaaggccttgggctggccactggtcgaattatcaccaagccatttcataaagaaggggctcgatttcatagaaagtaccagcagagaaatctttaacgatctatacaatctgcatcatgctgtcgtattcttcgatgaatgcgatgaattattcagaaaccgatccgagtccggagagacaacatcgagtaggacgatcctcaatttcctcacggccagcatgcttcccaaactgcaagatttacatgataagcaaaacatcattttcgtattgggaacaaattacttacataatatagactcagccgtcagaagaaaaggacgattcgatcacaggatacttttcgaccgtccggacgaagaggccagacgactgttctattgggcaaaaggaaaatctaatgactctgatattagcgaggatgaatttgtcaaacggacaaagaccgcgttagtcaaagatcttactaaagctctctcctcatcgtaccaacaagaagaagaccaaagctatttggattggtgtggcgccaaaggcgaggattccgaaggtttattggaattaaagaattgtgataaatcggaatgccatcaagagaaaataaaagaatggaacaagatgttgaaagaaaacaaggaataagatgctgaacaaaaggacttcttgtgagttctgcacggaaattcatgatcccgaagatagcctttttgggaaattatatatgaatgccaagatcccatctaggatcatgaaagattgtgagcattttgtcgtgatgcccacaattgggcattttctcaagcactacctgcttgtcatttcaaaaaggcatatcgaaagtatgtccaaactcaccgatgaggaattaagtgaattggaagatttactgaatggactcaaagaaaaattagcatcgtacgggcatgttgtatgttttgaacatggaggaggttcctttaaatatagcacgtgtagcgtataccatgctcatatccacataataccagtacctacttctcttgatttaacctctttcttactcgaagaagagaatatatctcggttccatacatttacagaatgctatcagagtcttaggaatactccgcaatatctaatggcgatgaacgcagatggctccatatacgctactgatatctccaaaacacaagaaagatatgtgtctcaattctttagaatgaaaatcgcggaatattacaaaatcaacgaagaatgggactggaaaaggatcaaggccatagagccaaatctcatccaaacgctcaatgatatattataaactctttaatttacatacgatgaataaagaatgggaaaaggtaaaattattccacgataaattcgggcaccctagttctgatcgtcctgcttttatccccaaggaacgtgcgaaagatagggcaaaatggcttatggaggaaatagccgaatttctggtcgctcctgatatctacgaacaagcggatgccatgatagatctcatctatttcgctctaggcactttagttgaaatggggatcaaaccggatgagttgtttgatatcatacaaaaagcaaacatggaaaaattaggagaagacggaaaacccatatataaccctaaagacggaaaaatcatgaaaccccagcattgggaagatcccgctcctaagataaaggcatacatcgataatctatcacagaacagttaacgaacctgcccaattttgttatacaaacaaaagtaagtacctttgttactaattataacacttatattaaaatcaataagtctatgagtacaatttctatcatcgcagcaatcgcagataaaagcgcgatcggaaagaatcagcaattattatgtcacatgccttcagacatgaagcgtttcaaggaattaaccacgggacatgcggtaatcatgggacgtaagacattcgagtctctccctgtagcgccactgcccaatcggaagaatgtcgtattgacgactatgcccgaggctggtttcgtgaattgtttcgcttgcgagtctatgggggccgctctggatttatgtgagaaagaggacgagatattcatcattggcggtgcgttggtctacagacaggccttgagaatagccgacaaaatgtatattacccgcatccatcatgagtttcccgacgcgacctcgttcttccccgtcgtaaactgggacctttgggaagagactgagcgtgaggagtatcccgcagacgagaagaacccttacccctacacttacatcacctacgtgcgtaaaaaataaacattaacgtacgttttacaactttttgctctttctttgtatctatataggaaaggtttattgttaaacttataaaacccaaaagatatgaagataagagcaattattttatctgccctgatactttgcggcatctcggcggttattatgtatagccgggccgcccagcctcaacaaaaaagttctgttatcacgcaagctataaacgataagaatacccctatggtgatcaagaatcttatccttaaaatgaaagaacagatggaggtaaacgatgatcagttcccggaactgatcaaggaggtggagaattacaccaacagttgcgccgactcggcttccgtggcggtattacattccatgctggcggagatgtatcagaattactaccaacggaaccagtggaccatcaaccaaagaacccaattaagcggttatatcccggaggatatccgggtatggacttccaacttattcacggataagatcaaggaagagatcgatttatcattgcgacctacggccttattgcaaaatacgcctgtcagcaagttcaaggatattctggagatcggaaaggactcgcaaaccctgcgtccgaccctctatgagttccttgccttccgggcactggacatccaaccgaccgtacagatctataaagacttgatcgcctttcaaaataaggagccgaatatgaaatcggtcctccttacggaattggattacctacgattcctttacggggataaaagggataaagagtcttttgaggcttacatgaacgcattggatgagctttacaggaacttagcttctcaaaactatgccgccgagatcttaatcgccaaattggatttggttagcggcagtatgtttcgttacgtctctacccaatgggattctatcaaagcggaagaggtgaaactatgcgaggagggtatcaaacgatattccggttaccctcgcacggctatcttaaagaatcgcttggcacaattggaacaacctactttatccgcatctacaaacaatacggtttatccgggacagcaactggggatcaagctggaatataagaatgtacagaaagtcatcgtacaaatctatcgaagctcgaaaacacctttacaagcggcagcccatacatccgcaaaaaaatcaagtggcagcaccttgggacaactcgtaaacgagaagacattctctttgctactgcccaacacctattcgcagcaagatacgaccttacatatatctatggatcaaccgggattgtatgaatgtgtcgtaaccgtacccggacaacagctaaagacgatcaatacggttagcgtaacccgattggccgcaatctatcgtaatctttccggtaataaacaagaggtcatggttaccgactatcttagcgggaagccggttgacggagcgatcgttacctattacggcggtcagcgtcgtaacttgcaagaactgggtaccgtcaaaacagaccgggaaggattggccacgcttccggcgaacagtcaagtattggcgttccaagccagcagaccgggagataccaacgctatgctgacaaatatctacccgatgggttccggccgcagaccggaaaagaacccggtagaagtctcgatctttacggaccgtggactttaccgtccgggacaaaccattttcttcaaaggtctcgcctacgtaaaagactcgaacgacccgcatgccgtggccggacagacttttacggtgactttgtatgacgctaacgggaaagagctagcccagaagaaattcacgactaatgacttcggttcttttaacggcgagttctccatccccaaacagaccctaagcggcgtcttccggttaagtaccggacagatgagcgtatatattcatgtagaggaatacaaacgcccgactttccaagcgtacttcctcccgatcaagggcgatatcgctttcggcgattccgttaccatacaaggcaaggcggctacattttccggcgtgtcactgcccagcggcgatgtcacttggcgtattacacgcaggcccttcctgttgtggaagtatttccgtccgagcgctccgacacaggtagcggaaggtagcgccactctttccggcgatgggacattccacgtatctttccgtccccaaaaagaggaagatccgaatccatacgcttccgcataccagacctacgaggtatcggctaccgtaaccgatagcaagggagagacccaagaggcgaattacaccttctcggtaggagaatccagtatcgtcttattcaccaacctaccgccacaaatcgagaaagactcggtaaaagccgtagtcgaagcccggacaatcaatggggagatggtttccacctccggtactttcaagatcgtagaactgatcgcaaaccgatccgataagaatagcggagagagctatcaagaaggcaagcaagtagcttccggtagctttaccagtggcaaagaaatcagtccggctattttcaacccattgccctccgggcgttaccgtattttagtagaagccaaagatagccaaggacggcagagtaagaaccagtccgatttcatcctatacggaaagaacgacaagcgtcctcccgtatttacccatacttggctgctgaaagagaagacaacttgtttacccggggaggaagcggaaatcgtattcggcacctccgacaaggacgcctacgtactctatgaatggtttgccggaaataaccgcatccatcatgagttgattaagctaagtgacgcgaaccatcggtttaagatcccgttcaagccggaatatggagagggaatcatcgtatcctttacgttcgtaaaagaaggtgaactatatattacccaagtacccgtagagcttcagctacccaaccggcagttgaccatcaagccgataaccttccgggatcgtttacttccgggaagtaaagagagctggaaattccgtatcaccgacgcggactccacgatcgtatccgccgaggtactgaccagcatgtatgatgcctcgctagataaaatcataccattcaattggtatttctccccgcagcgaacgatcctgctacaagctccccgtttctcaaccggagccggattccagcgtagttatcaatatgaccagacagaggccaagtatataaaagtacctcaatatcagtatgaccgtttaaattggttcggtctattcaatgagattgtcatacgaggatacggctccagcaaccgggctttcgccacgggtggtatcatgctgaaatccgcggcagccccagtagtgacggaatccatgaacatcatggaagacagcgccgtgttagaagagtctagcgtggaatctacggaaggggaacccgtgttcaacctatccgatcctttcgccaaagagagcagccagccggtaagtccggagcaaatccggcagaacttcgcggaaaccgccttcttctacccgaccttacaaacgaacgaggaaggagacgtattcgtaaatttcaccctgccggaaagtaatacgacttggaaactacagctattggccaacacccaagacctaaaatacggtctgcttacgaaagaggtcattagcagcaaacccttgatggttctaccgaatctgcctcgtttcgtccgccaaggggatgaggtcagcatcaacacgcaagtcatcaacaattccgaggaagcggtatccggccgtgtacgcatcgaactattcgatcccgctacagaccaaccgattatctgcttgagcaagtcacaacgtccgtttgagttgcaaccggatagcatcgctactgtaagctggatgatcccggtccccaaacagatcaacctactgggcgtacgtatcctagccgactctgaaaagggaagcgacggggagcagcagatcgtacctgttctttccaatcaattgctcatcacggaaagtaccccgttctatttgctcaaggaaggagagaaacaaatccgtatctccgggaactcggagggagcgacaccattccgtctcacgctggagatgaccgggaatccgatttggtacgcggtacaggcattaccgacgatcacacagccgaacaatgataatatcttatcttggtttgccgcttattacagcaatacgttggcttcctatatcgcccaagcccatccccgcatccagaaagtgatcaaccaatggaccgctcaaggagggaatgcctctactctctattcaaacttggaaaagaaccaagagctgaagaacatactcttggaggagacgccctgggtactagccgccgataacgagacagagcaaaaacaacgcttgtctttattgttcgacctaaaccgtgcggacggattacgggaagcggccttgcaacaactgatccaacaacagaacgaagagggtggatggagctggttcaaaggtttccccgcaagccgtgcgatcactctttctatcctgaaaggtatgtcacagcttgtacagctaaacgcgatccaatatgggcaagcggagaaagagatgcaaatgaaggccctcaagttcttggacaaaagtatgcaaacggattatgagaacttgctgaaatacgataagaaatggcaaaacgcatggccctcgccggagcaggtagagttcttattcgtccgcagttcctaccgggatatcccggaactgggagacgcccgggaagcgatccgtttctatacgaaccaagcggagaagcactggaatcaatattccttaatcagtaagggcgaaatcgccttgttaatgcatcgaaacggtaaaaaggaggtggcgacagcgatcctgacaggactaaagaagaccgctacgatctccgaggagaaaggtatgtattgggcaaacaaccgcagggggagtgattatttcacctcaccgatcgacacgcattgcttattaatgtccgtctttaacgagatcgcgccggatacccagaatacaaaccggatgaaacaatggttgctaaaccagaaacgtacacaaaactgggaatccgtacccgccacggtaaacgccatttacgccttgctactcacgggtagcgattggctgaacacgcaaaacacttgtgtagcgacatgggacggcaagatctatagtaccgcggaaggggaaatcgccaccggttacctcaaaacgatacttccgaacgagccggcaaataattccgccaaccccgtgctctcgatccgcaaggaaggaaacacgccggcatggggagctgttttcgagcaatacttccaagagatcgacaaggtaaaaggacaaaaaggggtgttgagtgtcgagaagaaattattcgtcgagaccaataacggtaccaaccgccaaatccgtcccgtaacaccggagcaaccgctccgcatcggagacaaggtaatcgttcggctaacgatccggacagaccgtgaaatgaattacgtattcttgaaagatctacgtgcgggctgcttcgaaccggccgatcaactttccggcccggaatcaagagacggtatctggtattacagatccccgaaagacgtatccgagaatttcttcatcaatcgtctgccggaaggtacgttcgtcttggaatatccggtctacgtatcccgtagcggcgaatacgccggaggtatcagtacgattcaatgtatgtacgccccggaattcgtgtcgcacaccgccggagaaagcttgcggatcatgccctaaacaagccttttcttacaatgcccgttctaacctccttacaatgcccagtataaggaggttagaatgggcaccgtaagaaggtaagaataggcatcgcaagaagcgttatcttcctctaattttcagttttcaattctcaactttcaattgaaatgactatctttgtaattcgaattaaaactaaacgataagatgaaacaaatagtttttattttcatggcgatcctgttagcgacaggaatggcttcggctcagaagaaagcagttatttccgcggaaacaaccagtttcgacttcggtaccatcaaggaagcagacggaaaagtatcccatacgtttgaagtatccaatacgggcgatatgcctctggtcattacacgtgtaatcgcgtcttgcggatgtacgaccccggaatggccgaaagaaccggtagctccgggtaagaaagcccagatcaaggttactttcgatccggcaggacgtccgggtcctttcacgaagaccatttccgtatacagtaacggaaaaaccggaagcttcatcatgaacatccggggagaggttgaataagaaatacgtaaaaaacccccaattggaatgctgaatataaaaaggttgatccttgctcttacagcaattatatctataacgacagcttgggcacaacaaggcgcccaaatcttgtcggacgagttgacttataatttcgggacaatagccgaggccgatggattcgccagtcatactttcacgataaagaatacgggagacgcccctttggtcatcacccgtgttaccgcgtcatgcggttgtacacggccggaatggactaagtcgccgatcgctcccggtaagaccggtgaagttaagataacgtataatccgaaaggacgccccggcccgttttataaaaccgtatcgatattcagcaatgggaagaaagggagttacagcctagccattaagggaaatgtcaccccgaaaccttcgcagccggtctttacgtatccttattctatcggtgatctgaagctgcatacgaagactgttctattcagcagtatccgtccggaggaaacgttgggcgagaagatcaacattaagaacgagggaaagacctcggctacgattcatctgggtaaagtacctcactaccttaacgtacaggtgaacccggctacccttcaaccggacgaggtcggtgccattacgatccttatggatgccaaggtcctgaagcggaaaggacgagtctctacgcttttgccgatcatgatacagagcgccggaaagaaggaagtatccggagagatccagatctccgccaacgtgaccgataatttcagcaaactatccgctgcggataaagcccaagccccgatagcggaattatccggcactttactggaattcggcaagctaccgaacaagaaaagtatcgttccgttgatcggtggtaaggtatcgggtacgtttgagattacgaatgccggaaagactccgctcacgatctacagcgtcacttgtgatgatgagcgtgtcgatttgtccggcggcaagaaagaacttaaaccgggagcgaccgctactttcaaagtaaccttgcgaccgaaagagataaagacaaaacttgaagcacttattaatgtcgtatgcaacgacccgaacgggcctatccgcttgatcaaggtgacggcatacaaataatagattgatatggaacatccagaaaacgatgatcagtacaagggattgaaagtgaataagggcattgcggatgtccctaccgtaaatccttatataaaaaagcgtgtccaacgcaaggtatatacgccttccgaattcgtggaaggtatcttaaaagggaatatcacgatactcagtcaagcagttaccttggtggaaagctccaagcatgagcaccaacaggtggcgcaggagattatcgagaaatgtttgcctttcgccgggaaatcggttcgtatcggtattacgggtgttcccggagcgggaaagagtacctctatcgactctttcggtatgcacttgatcaaccaagggcgtaagcttgccgtactagcgatcgacccgagtagcgaacgctcgaaaggtagtatcctaggagataagactcgtatggaggccttgtcgagagagaaaaacgcctttatccgtccttcaccatccgcaggctccttagggggggtcgcccgtaagacccgtgagacgatcgtattatgcgaggccgccggtttcgataccgtattcgtagagaccgtgggtgtcggacaaagcgagacggccgtacattcgatggtggacttcttcctgttgattcaattggccggtaccggagatgagttgcagggtatcaaacgaggtatcatggaaatggcggacggtattattatcaataaggcggatggagacaatatcgaaaaggcgaatctcgccgccgctcaattccggaacgccttacatcttttcccaccttcggaatcgggctggttcccgaaagtattgacttattccggctattacaacctaggtatcaaagaaatatgggatatgatcggagagtacatggagttcaccaaaaagaacggctacttcgattacaaacgtaacgagcaagctaaatactggatgtacgaaagcatcaacgacacgttgcgggataagttctatcataacccggcggtagaaggcatgctggaacaaacggagaagcaagtcttgaacaacgagatcagctctttcgtggcagccaaacggatgatcgatctgttcttggataatatcgctacgaaataggtataaaagcataagagtgtcgcacgatctgatcatgctacactcttttttacttgaaccttacatcgactcctttgtcttctttcgctttcacggccaacgcacgcccttgtctctttacctctcctgtgatgaattcaggtatattgtaggatttcataaagcgaaaataaaaatccgtatccttctggggtaacaggaaaggtttgcaagcctgtcctttctcatcgatataagcgatgaacagccttgtatacaaaccatccatccgacggctgctaaacacgatccaacgactatcgctactccatgaatgatagctttccacatcgtcgctattcgccgcctccaatggataacttcgcagagtcgataaatcaatcatgtacaaatcggcatccttatgccaaatagagaaattcccataaccggacaaggtatagagcaaatactttccatccggggaaacccggggaaaagaaacgcttttatcgatctccgatgccttatataaagtatcgactaccgtcccgaaacggcgtgtagcgggatcgaacgagactgagcatagatcgtatctcacttgatcgtattccttgggcatcgtacgggctttagccgaacagaaatagagcgtatttccatccggggaaaatgtagggaaagtctcgaacgctccctctgaagacagcagcggagaagtcacgatctcatgcttttgcgtatcatagacgaccacatccgaggccgagtcgaatacctccacccgattcctatcgttcatatgaaacgcttgcttggttttattcacagagaaagcgacatattttccggaaggatgccaagaaggatagaccagtggagaaagggtctgatcggtcttcgtattcagcttctccactttatctccatcgatcaataaggtacaagaataggtctcacgcatatggaaaagcattttctccggattctgcatacagaaagaatggcagttcatacagttattgccgctcatcttattttcgatgatcgcgttctccgtataattttccaagttacgttgatagatacccatacggttccacaactcatagcccggttcgattaaacgataagccaaccaaccatcgaccggctccttcgccaccttgatgatgaagggggcatacgcgatccattcatcattcacgaaggcttgtacggttacattcagatgattcccggaagcggcacgcaacagccttttccaaccggaggccgggatcacgaaacaagcgtctttcccggtcttgatctctaatttctccgggccacattcgagaatggcacgggcctcaacgcaagcatctttcagcttaaaattcaagggagctatattcggcgggattgtcacatccacataatccggaaagatctccggcttgacttccagattcttctgtatacgtaccggaccggaacaagccatcaagcccagaatcatccacagacatatacatcttattatatacatttttctcatctcctatttaaacatataataataccaataggtatcgccataagagcgatacatcaaaccgggcagcgcattactattattccgcccagcgagcacttgcctcttataatcggtgaatcgccctacgatagattccgagacaccgaaacgtttccagtaatccggatctttctccgataggatgatgaccgcctcttgaaaagagaccggtaaagaagggagtaaatccgttccgtaataggtttccaccaacgtcttaaagcgcgtcacatcttttgctaaaagatagaacacgccggcatagtggaaagcggctttattggaaggattctgctccgccaagcgaatcaagtccgtgtcgaatccatccatctggatcagatgattctcagctagcaggttcctgcgcatattccccaatagaggatctgtctcgaccgcctcatcattatacaggaatttccgctgcgctttggcccaatccttataatagaaagtattctctaagacagcgatatatttctccgcgaccggataggctccataaatcaagttcgtttgcaccaaacgttgcgtcatgcggggatttccatcacataaagcgccgatattactctcgaatgccatctcttgagccgcggcgacatttcccatcgtaaaataaacatcactcaacaaggcggatatggtggtcgatttattccatgccaccattaatccacgaggcccgtgctgcgtgtacttaaacgcctcatccgccagaatatctttccgggccaaagccatattttggtaacataaatagagttgattagtggtcggctccttgcatgataccaagatccggtcccattgctctgtccgagtaaaatagtccatcatcttcaaacggtatgatttctgttcgccatatagatcgaagcctttccagaagataagccctaagataatgaattgggagattcccaacgctagacgctttttaccagcccatgattccttgtttttacagaggcaggttacaaccaacgccgcatagaaagcgatccatgagaaataaattaccttatccggcaccaaacggaaataataataactatccggtaaaaagacaaagcggtattctccgatcaccgagtaacgcacacataatccacccaagatcaacacgatcatcggtaaaatcgcggaataataccaacggggcgtccggctcatggcctcatatccgaccatggataaggcaaacaacaaagagaccggcccggccaacccaaagagtaacagggaggcaaacagacttgctatcaaacgaggtatgaaattccttatccctaaaacgagatataaagcaagcagcatcataccgaaggcgaccgttccttgaaacctgtaattaaaatcccattgcacaaacaacaaggataggacgggaagccaagcccataaaataccatggcttcgcggatcgatccgcttcaagatcgcccagaacaaggcccctaggcttgtcagcagggccgccgttatcatagctcccacattcgggagaatgaagaactgcaccaaacaaccggagagaaccatcgctaaacctcccggttgcattaacttatcgataataaaaatgggagtcaactggaataactggttctgctcgacacagtaaaaatggtactcactgaatatcctcaagaagataaacagaaagacaaatacgattacatgcaaggccacgccgctatacttcttcatgatatcaggttcttcaaataaaaacccggatgtacgcaatcgctacatccgggttcctattcgtataaacatatgccttatttagattgaagaaacacggagcgtgttcaacaaatcccggttaataggcttatcattcttgatcgctttagagaacggtacatagacgatctggtcgttctggatacccatcatcacgttacgctgatcatccaacaaggcgtcgatcgcagccacgcccatgcgcgtcgccaagatccgatcttgtgccgtaggagaaccaccgcgctgcaagtgacctaagatagagacacgcacgtcgaactgcggatattccttcttcacacgctcagcgacccccatagcgccaccggttacctcactctcggcaaccaatacgatactactgttcttggacttacggaatccattctcgatcatctcagccaattgatctttctccaaggagatttccgggataatagcggcttcggcaccagaagcgatcgctccgttcaacgccaagaaaccggcgtcgcgccccataacctccacaaagaacagacgatcatgcgaggtagccgtatcacggatcttatccacgcattccatgatcgtgttcaaggctgtatcatagccgatcgtcgtatccgtgccatacaagtcattatcaatcgtacccggcaatcctacgatcgggaaattaaactcctgagcgaaaatacgcgctcccgtcaacgttccgtcaccaccgatagcgatcaaggcatcgatcccatgctcttgcaacttatcataggcctgttttcgtccctcgggagtcttgaactccacgcaacgggcggtcttaaggattgttccgccgcgctgaattatattactgacattttgtgtcttaaactcttcaatctcatccaggatcaaccctttgtaaccacggtaaatacctttcactctcattccgttataaatagcggaacgtgttaccgcacgaatagcggcgttcattcccggggcatcacctccggacgttaaaataccaacacactttactgtagacatagcgtcattgattttaatgttctccggcaaaagtagtaaatatttagttatccttctgtctttctcccggaaagttcacgtaatcttaatcaaaatatcattccgaagcgttcaattccttgatccggaccgctacttcctccatcaaccacttgggagtggatgtagcgccgcaaaccccgacccggcgcacgccctcgggcaaaggctcggtaatctctgatacctcggaaataaagagcgtattcgggttcgctttccggcactcctcgaacagcatcttcccgttggaacttttacgaccagccacaaaatagacccaatcgtggctggaggcgaacgcttttatattcggaagacgattcgccacctgacggcaaatcgtatcgtaataattaaactccaccccttccgccatccgctgcttgatctccgccactaccgccttgaatccatccaaggacttcgtggtttgggaaaacaggctgatcgcacgggtaaagtccagacgatcgaggtcttctattttctcgatgacaatcgccgtgccctccgtctgccccaccaagccattcacctccgcatggcctttcttcccatagataaccaactgggtgttattcgcccgggtctcttgataacatttatggatcttgcgctgcaaacgcaagacaaccgggcaagtagcgtctataatcgtgatattgtttcgcttcgctaaagcataggtagaaggtggctcgccatgcgcccggagcaacaccttccggtctctcaaccttgaaagtccctcatggtcgatcgtatgcagccccatatgctccaaccgctccacctccaaactgttatgaacgatatcgcctaggcaatacagcgtatccgtatttcccagctcccgctcagcgctctctatggcggtgacaaccccaaaacagaatccggaatctttatctatctcgacttctatcatatctataatatcattaacaaacaagcacttacagttttcttaattttcaatcacaagaaactaaagtttcttcataacaaaactagagttttcccatagtgaaacttttgtttcctagtaacgaaactatagttttcattcgaagagacaaaagttttctttataggaaactccaagcactcgtttatgaaccgatcgctttatgatattgttccagcaaccaagccttttgctcttccaaggtcatatgggaattatccaataccaaggcatcatcagcttgtctcaaaggactttcctcccgggttgaatctatataatcccgcttcttcacattctccagcacttcctcgtaagaagcggggatccctttcgcctccagctcatccacccggcgcttggcacgtacctccggcgaggccgtcacgaaaagcttcaactccgcatccgggaatacgaccgtaccgatatcacggccatccatcacgatgcctttcgcctttcccatctcttgttgcttagcgaccaacgcacggcgcacaaagcctagagtggctaccggactcactttatccgccacttccataccacggatctctttctctacattcacaccgttcaaataggtatccggccggccggtctccgcgttcaaacgaaatgaaatatcgatatcatggatagaagccttcagctcttcctccttaatcttctctccctcaaaaaatccatgctggatgcaatacaaagtcacggcccgatacatggcacccgtatcgatatacgtatatccaatctccttggcaagatctttagccatggtgcttttgccactggaagagtggccgtctatagcgataactattttcttcatatatatatatatatatattaatgtataggtttattctgtcaccttcttaaaatcggccaaggtcgtagatacgctaatcatcatcgacatggcggacggatgatatttcgccagcgagaagcccacgtcaaacatcttgatccttacacctgcgcccgccgagaagccggagaaacttcccccgcctttcaacttcatatccatattgaccttcggattgaatcctacgcccacccaaaagttctcggacgggataaaatccacgccgatgataaaatgcttcgccaacgtcttaacgaaagaatccccgtcatactctttatccgtattatcgatataatcgaacttccaacggttcaagtattgggccgtcaaagaaaaacgaatcggggcatgcgccattttctgcgtgatacccatctggatatcccaaggcatcttttgtcgctcatcctcgtaagctttcagttgcgcgccgatattcttcaaggcgaaaccaaaggaaaagcccttatccgaattataataactcaatcccgcatccacgcataaaccgatagaggtataatcagccagccccgaatacaagaacttcaacgataatccaccccgccaacgctcattcaagtcacgggagtaaaaaccgttcacgctgatatctttcgccgacaggctcgctccggtcacgacgttatccggtaacacctccttgatatcgccatagcttataaacgtagcgcctacgccccaagcccctttctcgccatgcgctttcgtgaacaaggcacttcctacgttgatatccgagatgtaattcatataattcaagttgatcatcccatccatctccgcacctagcaaggccggattatggaagataagcgaagggtctctttctaccaacgccacggtatgcccacccaaggcgttagcccgggtcgaggtcggaaaacgtaagaaagtatacgcctcactcccgttttgcgctgagacagacagtgtaacaacgaataaaatcagtataaatagtttatttctcatattttcatgcaaaaaatcgttcaaagatacattaattcggaaaaatgtttttactttacacccgcaaatctcagaaatacggatttcacattaacagaaacgggaaaaatgccaaaaaggtatattatcgctctcatttttgtttgatatatgaaataatttgtatttttgcagaagtgaaaaacacttataaattattataaacgtatggaaattaaaaaatcaccgaaagcggaccttgagagaggtaagtctctaagtatcctgatgggattcgtagtgggcttagctgtcttgttcgtgggcttcgaatggagcacccgcgatgtaatggtcgttcaggctagcgagggtgtagcagacatcatcgccgaggaagaagtggaaatcacgagaccggagaatacgcctcctccacctccaccacctccagcaccagttgtaaccgaggttttgaacgttgttgaagacgacgttgaattggaacagcaagatatcttatcatcagaggataatcagcaagaggctcaaacagccgtttatacaccgcctgcagtagtagaggaagaagaagaatccgctcagcagatctttacggttgtagaggaaatgccgaagttcccgggtggagacgcagagttgctgaagtttatcgctaaatcaatcaagtatccggtaatcgcacaggaaaacggtatccaaggtcgtgtaatctgcgcattcgtggttaaccgagacggatcagtagtagacgctgaggtattacgtggtgtagacccctcattggataaagaggctcttcgtgtgatcggtaccatgcctaaatggactccgggtaagcagagaggtaaaccagtacgtgttaagtatactgtgcctatcacgttcagattgcaatagtataacattaaacatatcaaaaaggctgctttattttcgcagcctttttttatttcataactccattaattgatacagctatgttagcattcgagaatatacttcaaagaatagaaagcgagatctctcaactacaattcaccaatcctcccaagagcttatacgagccgatagagtacatcttgtccctcggaggaaaaagaatacgtccggcgttaacgttgatggcatgtaatatatataataatagtatagagaatgcgatcaagcccgctttaggtctggaagttttccataacttcaccttgctgcacgacgacctgatggatgaagctgataaaagaaggaacaaacctaccgtacacaaggtatggaatgccaatacggcgattctttccggagatgcgatgctaatagcggcttatcaattaatcggatcaacggaacacggccaccttaaacaagtgttggatttatttacgcaaaccgcggcggaaatatgtggcggccaacaattcgacatggaattcgagtctcgcatggatgtgagcgaggaagaatacatcgagatgatccggctaaagacagccgtactactggcctgctcccttaagacgggtgccctactcggaggtgcctcacaggaagacgcaggcaacttatatgcgtttggtatcaatataggtctagcgtttcaactgcaagatgatttactagatgtatatggtgacaccgccactttcgggaaaaacattggcggcgatatcctttgcaacaagaaaacattcttattgatcaacgctctcagactggccaataaagaacaagcggaagctctccgtagctggatggataaaaaagaattcgacccggctcaaaagatacaggcattcacctctatctacaacgaattgcagctaaaacaattaacagaaaataaaatccaagcctattacgacgcatccgtagagaacttaaaagctttacaagtcgcccccgaaaaattaacgatcctaaaagaggtttgtgatcatttaatgcatagacaatcctaatccatgaggttaatagacacacattgccatttatatctggaggatttcgatccggagcaagacgaactggctcaaaaagcaaaagactcaggtatcgacaccctgcttctgccaaacgtagacctgacgacgattgacagaatgcacgatttatgcgatcgatacccagagttcgctttccccatgatgggattgcatccgaccagtgtggatagcaattatatcgatatcctaaaacaaacggaatcctatctatctaaacgtacttattgcggtatcggtgaaatcgggatcgatctatattgggataagacttatttaaaggagcaacaaatcgttttcgaggaacaattgcgttggagcatcgatctgaacctgcccgtagccatccatacccgcgacgcatatccggaagttctggaatgcatacataaagtcggagcggaaagacttaagggcgtatttcatagttttaccggcacaacggaagagctggaagaaataaagaaactgcccaccttcaagatcgggataaacggagttgttacctttaaaaattcaaaactgtccgaagtcattcggcaaacggatcttaaaaagatactcttggaaacagatgcaccctatctttcaccagtcccctacagaggtagacggaatgagcctacttacatatggaagacggccgagaaagtggcggaaacattcggcctcacgctagaggaaaccgtaaacgctactcgaaaaaacacattagaattgtttaaaagcgtaaataaacccatatagacactttttttcgaatgaagtcaaaatttatttcgtggatattgtgtatatgtcaagcaaaaactatagatttgtgcactgaaaagattgcatatgggaattttttcgtattttgcggtcgttttagaagaagctaggcgaataattggagagatgctcgagtggttgaagaggcacgcctggaaagcgtgtaaacccctaaagggtttcgcgggttcgaatcccgctctctccgcggtggagaataccatgaattaattaacaataaaataaaaacaaataagagaattattaatcttaaaaattaaacacacaatgaaaaagttatttgcaaaagcattcttgggtttatgtgcccttggaacttctaccgtagcattcgcgcaggacgctgcagacgcagctacagctgttgaaggaggtatgtatcaagcattaaaaacaaagtttatcgaaggtggtgccgacttcatgagtttggttgctatcgctttgattttcggtttggctttctgcttagagagaattatctacttgaacttagctgaaacgaattccagcaaattgttgaagggtatcgaagatgctttagacaaaggtgatgttgaaggcgctaaagctatcgctcgtgacacaagaggccctatcgcttctatcgcttaccaaggattgatgagaattgaccaaggtatcgacgttgtagaaaaatctatcgtttcttatggtggtgttcaaggaggtcttttggaaaagaatatgtcttggatcacattgtttatcgcaatggctccgtctttaggattcttgggtactgtagtaggtatgatcatggcgttcgataaaatcgagcaagttggtgatatcagcccgacggttgtagcaggtggtatgaaagtggccttgattactactgtaggtggtttgatcgttgctttgatccttcaggtattctataactatttgttaagcaaattggaggctatcttgaatcaaatggaagatgcttctatctctttgcttgacttggttatcaaatacaacgtcaaattcaaaaaataataacgaattatggcagttactaaaataagaaaaatatccagttggactttactgataagttctattatcagtattattgttctgggtatgttttatgcgggtggagtcgttgaccctgccgctgaaatgaaagagcccatctataccgggttattgattaactggacttcagtattgttcttcgtgacaatcatcagtacaatgttgtttgccgtttggcaatttttgacgttgttgaagacaaacgctaaatcagcgattatgtctttggttgtattggtttgcttcgttgccgttttgttcatcacttacacgatgggtgacgcaactcctttaacaggtttgaacgcagactctcaagtttacaacactccgggttggttaaagatcacagatatgtggatcatgtctacaatcgtacttttggttctgatcgtagcatgtgtagtttggggttctgtaaagagaatcatgggtaaataatagtaataacgaactgataaaacaagaaagaaatgggtaagaaaagaaagacaccgggtatcaatggttcttcttcggccgatatcgctttcatgttgcttatcttcttccttattactacatcaatggatacagataaaggtttggcaagacgtttgccgccccctgtacctaaagatcagaagaacgataccgatgttgacatcaaaaagagaaacttgttggttgtattgatcaacagtaataaccagattctctgcggtgatcaatttgtcgatatcaagcaattgaaagaaagaatcaaagagttcattgataatccttataatgacgaacataagcctgagcgtgtagaggctgatgttccattcttcggaaagatgatggtaacgaagaaccacgtaatttctttacagaatgaccgtggtactgaataccaagcttatatcgatgtgcagaatgaaattgcggctgcttataacgaattgagaaataaggtttctaaggaaaaattcggtaagaatttcgctgatttggacgaagaacaacaaaaagctgtacagcagatttatccgcaaaagatatcagaagctgaacctaaaaattatggaggtaaaaagtaatgggaaagtttagtaaagcgggcggtcgtgaaatgcccgaattgaatacatcatcattacctgacttggtgttcgctttcttgttcttcatcatgatggtaacatctatgcgtgaggtaacattgaaagtagagttccatgctccacaagctacagagcttcaaaaattggagaagaaatctttggtaacatttatctatgtcggtaagccgactagagatttgagagcgaagatgggttctgaaactcgtatccaattaaatgacgcttttgcggaaacttcggaaattcaggattatatcgcacaggaaaagtccagtatgaaggaagaggaccagccgtttatgacggtttctatcaaggctgataaagagaccaagatgggaacgattacagacatcaagcaggctcttcgtgaagcatacgcattaaagattagttattctgccgctcaacgtgtcgacgaataatgatctacaaatagaatatctaaaaaaggcgggaaatagaatcccgccttttttatttcactccatagacattttggtgaataatggtcttaactcgcttaaaagatcgctccagatcaagttccccatgagtcatcaaacgcatttctaataacgcctctcctctacgatatggaggttggaaatatacatggtgatccaagacaaaccccagacgttcataaaaaccgattctacgtttactcatctcctctgtcggcatctctacctctaagacaaccggatcttcgtggagagctaaaaaacttgtcattgctttcgctccgattcctccgttacgagcggactcgtcgatcgcgaaatgctccgcataaacaaagccctcaaattgccatcccgtaatgaaacccacataaataccatcccgtagcaaggcatacatctcgaaacggctatcttcctccaaaagcttacgtaccaaaaagaaatcacgacgctcttcctcggggaaagaactagtatatgttttctctactagatccaataaaggatcggctatctcccggacaggcttactaattattacatgatcttcgctcataaaaaaaatacttaataattgaataaagaatgcttacaaaatcaaaataatctaacataatctttaggtgattataagattatcattatatttgtattaaatatgaaagatataatctaacagtaatacaaatatactgaatatatggcacatcatcaactagatgaactggacgagaagatacttaaactaatcatcggcaatgcgcgtatgccatttttggaagtagcgagggaatgtaacgtatccggagcggctattcatcaacgcatacaaaagctgactaatttaggggttatcaaaggctcagaattcatcgtggataacacaaaagttgggtatgaaacttgcgcatatatggggttattcctaaagtctcccggacaatttccaagcgttacagaagcgctgttgcagataccggaagtcgtggaatgccattatacaacggggcaatacgacctgtttataaaaatatacgcaaagaacaaccagcatttgctaagcatcatccacaacaagcttcaaccattgggcttggctcgcaccgaatcgctcatatcctttaaggaggcattcaaaagacaaattcctattgatctggacgacgattaataaaggaagctaatataagaaaagggtccgtaattcggttgaaaccggttacgggccctttttatcatgatcactaagcgctattagaactcagcattattcggtgtacgcgggaaaggtatcacgtcacgtatatttgccatgcctgtaacaaacagcaaaagacgctcaaagcccaaaccgaaaccagagtgaggcaccgtaccaaaacggcgagtatctaagtaccaccacatatccttcatcgggatgcccaactcatcaatacgagtcattagcttatcatagtcggcctcacgctcggaaccgccgatgatctctccgatcttcgggaacaatacgtccatggcacgcaccgtctttccatcctcgttttgcttcatatagaaagccttgatctctttcgggtaatccgttaaaattaccggacgtttgaagtgatcctccaccaagaaacgttcatgctcagaagccaagtctacaccccaataaacagggaactcaaatttatgtcctttagcgacagcctcttccaatatcttgattccttcagtgtacggcaagcgaacgaatgagtctttcaagaccccttccagacgagagatcaattccttatcgaacatatcgttcaagaacttgatatcctccatacagttatccaacgcccattgtacgcaatatttaatgaactcctcggccaactccatattgtccgtgatatcattaaaagcgacttccggctcaatcatccagaattccgccaaatgacgaggcgtatttgagttctcagcgcggaacgtagggccaaacgtataaatctgtcccaaggctgtagctgccaactcaccctccaactgtccggaaaccgtcaagctagcctgcttgccgaagaaatcgtcctcataaatgatagagccattctcatcctttttcaagtcgtacaaattcttggtagtaacttggaacatctgtccggcaccctcacagtcggaagccgtgatgatcggcgtatggaaatagaaaaagcctctatcatggaaaaacttatggatagcgtaagccatattgtgacgaatacggaataccgctccaaatgtattcgtacgaggacgcaaatgagcgatctcacgcaaaaactccatggagtgtccctttttctgcaacggataagtagctggatcagccgtaccgaagatctcaatctcagtagcctgtatctccacgctttgccccttgccttgggattgtgtcaagataccgtttacgctgatactagctcccgtggtaatcggtttcaagaactcatcacccaatttatctacatccacaacgatctgaacattattaattgtagaaccgtcattcaaggcgataaaattcacctgtttgctaccacggcgggtgcgaacccatcctttcacgttcacggtagtaccgaaagcttcgcttttcagcacgtctacaatttttgttcgtttaattgtttccatctgtatcgtttttttttattcgaaagctcccatcctaagagcgttcacttccctttcatttaagtaacgccatttaccgcggcctaagttcttcttagtcaaaccggcgaaataaacacgatccaatttcgtcacatgatatcccaacgattcgaaaatacggcgcacgatacggttacggccggaatggatctcgatacccacttggctcttatcgtcctcgctagcatagctgatagcgtccgcatggatctccccatcctcaagctcaaggccgttggcgattttctccatatcctcgatagccacgttcttatccaaccacacatggtagatcttcttcttcttgaaagatgggtgagtcaatttagaagctaaatcaccatcgttcgtcaataacaagacacctgtcgtattgcggtccaagcggcctaccggataaatacgttcttggcaagcgttcttcaccaaatccattactgtcaagcgttcttgaggatcatcagaagtcgttacgcaattcttcggcttgttcaatacgatatacaccttgctctcaatctgaaccggcttctcgttaaatgtaacaacatcttgacgagtaatcttagtacccaattccgttaccacgacatcgtttaccttaacagcccctttctggataaactcatccgcctcacgacgagagcaaacaccagcgttagataagaatttgttcaaacgaatcggttcgttcggatccgccaagacttccttatacttgatctgtttcggacgcatgttgtaaccctgctgtctttggaaaccacctcctccaccggaacggcgattattattgtaagaaggacggcgattatttccatatccaccacccccttgacgattaccgccataagagttatcgttaccatacgaacgtctgggtgcgtaaccgtccccgccgcttgaacgtgaatcattgtaatcaacccgggtatcacctactctaggtcttcttttcttcataccatccgcagacattccctctccggaaggactagcggaataagcctttgccggtccatcataattaggacgagacggacgattgtattgccctcctccattcccatatgacgggcggttatttccataagacgagcggccgctgttgtagccaccttcacggttgttgccataagacgggcgattatttccatacccaccatcgcgattgttgccataagatggacgactattaccatagcccccctcacggttgttgccatacccgccttcacggttattatcgtaagaacgcggacggctcggacgatccccgtatgaaggacggttattttctccataagaccgatacggtctacgttcatagctaccctcaggtttattataaccctgattgtaaggtcttctttcaccttcttggtctgtgttttcccgtctgatacttggtatcactttttttggacgcagttgagattcatctctttcttctgtactcatttgttataaattaaacaatggttaaaaacttggtagcctcacggctacctgtattatcactaaattcctgtataattatgaggcgttatagcccttaattcatctttaatccggtcgctaacattcaaggtttcgataaactccttgatagattgctccgtaacagtctggttcgtacgtgtcaaagcttttaatgcctcgtaaggcttcggataaccctcacggcgtaagaccgtctggataccctcggctaccacagcccagcaattattcaaatccctacttagggcgttctcgttcaataacaatttacccaagccttttgttaagctcttgaaggcaatttctatatgtgccaaaggcacgcctacgtttctcaacacggtagaatccgtcaagtctctttgtaaacgagataccggcaatttcgtagccaaatgctctaaaatagcgttagcgatccctagattaccctcagcgttctcgaaatcaatcgggttcaccttatgtggcatagcagacgaaccgatctcacccgccttgatcttttgcttgaaatactccatggagatatattgccagaagtcacgattcaagtcgatcaagatcgtattgatacgcttcaagccatcgaagatcgctgccagattatcataattagagatctgggtagtccactcctcacgcttcaagcctaacacctcactaacgaacttgttaccgaatgccctccaatcatattccggatacgctacatgatgcgcattgaagtttcctgtagccccaccgaatttagcggagataggaacggcctttaacaatgccaactgttgctccaaacggtaaacaaagaccatcacctccttacccaaacgagtcggagatgccggttgcccatgtgtcttagccaacatcgggatatccatccattcctcggcgtattttttcaaggcgccgatcacctcttccaaacccggataatacacctcttgcaaagcgtccttgatcgataaaggcacagatgtgttattaatatcctgagaagtcaatccaaaatgaataaactcgtggtatttctccgcaaggaaatgatttgttttttccttaataaagtactccaccgctttcacatcgtggtttgtcacgctctcgatctccttcactcgtaaagcgtcctcctccgtaaactcctgataaattttccggagccccttttttacttccgccgcatttaactcgcttaattgcggaagaaactcagatagagtaataaaatactcgatctcaactcgcaccctatacttgataagtgcgtattctgaaaaataagccgccagattctcagccttattcctgtatcgcccatccacgggcgaaatagcagtcagtgtcgataataccatatacattattaatatagagtcgcaaagttaagtcttttccattgaataataaggtaagcaatcgttatttttaactaaatgccccgtttttaggaccatcagacacttacgtagccacatccaaacaaaattcatattcatccacattttttcgtcaaaaagtttggtggtaataaaaaaagccgtatctttgcagcgctttagagagataaagcgaacgaaaaaataagtttaaagggcgtttagctcagctggttcagagcatctgccttacaagcagagggtcggcggttcgaatccgtcaacgcccacctttaaatttattatttcaccgaaagattttcgggcgtttagctcagctggttcagagcatctgccttacaagcagagggtcggcggttcgaatccgtcaacgcccacttttaaatttattattttcaccgaaagaatttcgggcgtttagctcagctggttcagagcatctgccttacaagcagagggtcggcggttcgaatccgtcaacgcccacaatagaaaagattgtttggtttccagacagtctttttttatttaggaaccagagagtttacccgaggttccagaaacttttccaaagcaagttaacttccctacaattccctatctcttctgcgacaagaggacagcgatcagacgatctaacgagaacttaccaggtcctgctatatacatcaagataaaaacgaccaagtaaacgaacgccaactctttcaaagaaaacggatcattcccgtgaatcacgaagaaagccactcccatggtaaaaatcatcgggatcattgccaaccgatagagcgcaccgagaataaagccaatcgaacaaaaaagctccccaaaaatggccaagcctagagaaaccgaatgtccaactcccagtgggtccggaaatgcggcggacatgctctcaaaattcgtccacttctgtatcccatgcgaaagcaatagacctccaaataacaaacgaagcgccaacaacagtaacgatatagctgtaccatccggcttcattggaaaaagaaatttgtaaaatgctgacataattcccctattttttatcttatcaattcatctttctggtaataaaacaaaaacgaagtaaggttagttcagcaaaagctccgggaattgacaagcggcttatctttcgccttgcaaaacgtttgccactactatcataacactatttaccttattataatacaacgacttgaaataatacatcttcaaaagaataacaatttaacaacatgctaattacctttgttttccgtgttctttcattacttaaataactccatcataaacgtacataaaaactttcggttttttcgtaagtttgtagtcgaaaatatatttcactgaatatgagaaattaaattaaggagaacaggagtaacagtgaatatatcaaatgagtaagtatattacgaattattacatttagactatgcttttagaaaaactacttaaaggatttaattatagcaccagtactttcaatttgaaggaatctaagttatttgaccaatattttgaacgaatattgattagtaaaggtacatttttggtcaaggaaggagaaatagagaggtatagttatttcgtttttgatggaatattacgttgttggctattaaatcataaaggagaagaacaaatcttttggttttgtaaagagggtacgttctcaatgtcgaacatatcttttacattacaaacaaagtctgcgtttaatgtgcaaacaattgtagatagcgttatttaccgaatagacaagaaacaagaaaatgaactatacaccgctatacctaaggtaaaaactgtatttgaagatttgaatgctatattgctgaataaactcttgaaaagaaatatcgacttgattaaatattcccctgaacagtattatctacagatgattgaagaatatggcattacactaaactatataccgctaaaagatatagcttcttatttgggtatcacaccacaagcactaagcagaatccgtaaacgtattttttaacttagattcagtgctttaaatgtaaaagttccgaactttgtagctttaaatagtaattacaattatgattagaaaaattaaagttacagatcatccacgtttgatggaaatctgggaaagtgcagtattaaatacacatgattttcttaaagaggaagattttctatactataaggaacaacttccagtatattttcaacatgtcactctattcggatttgaacaagagggaatcttagtaggatttatgggaatcgcaaaaggaaatcttgaaatgttattcattgacaataattatcgaggtataggaataggaaaaaaattaatcacttatgccatagataatttgcaagtaacaaaagtcgatgtgaatgagcaaaataatcaagctgtcggtttttataaacatataggctttaacacatacaaaaggtctgatttggacggagaaggtaaagaatatcctattttacacatgcggttatagttttccttaaaatcacataaacaaaaaatccttggaaatctaatgattaccaaggatttcttgtgacccgggtgggactcaaacccacgaccttcagaaccggaatctgacgctctattcaactaagctaccgagccaaagactgcgcaaaagtacatataatatcttagtttagcaaatacaggagagaaatattttatttttgatattttgcatataagtattctgcttattctgccattttgcaaataaaagcgatcacattcttgttattttgccattaatcattatctttgccgcacatatttcacaaacacaaagtacaacaagtatatgagctatcttattaaacccgcagggtataaagccttacttaacttatcccagactgaaatgggaatcaagaagatcaaggactttttccagcaaaacctctcatccgagctgcgcctaagacgcgtaaccgcacctttattcgtacttaagggcatgggtatcaatgatgatcttaacgggaccgagcgagccgtcacttttcctatcaaggatttaaacgactctaaagcagagatcgtacattcactcgccaaatggaaacgactgacactcgccgattaccacattgaagaaggttacggtatttacaccgacatgaacgccatccgctcagacgaggagctaggtaatttacactctttatacgtggatcaatgggactgggaacgtgtaatgagcgaaagcgaacgtaagatcgatttcctcaaggaaatcgtccgtcgcatatatgccgctatggtccgtaccgaatatttagtttacgagatgtttcctcaaatccgcccgacgctcccccaacagattcatttcatccattcagaggatttgttacaaaaatatcctacctttacaccgaaagagcgggaagacgctattaccaaggaatacggggccgtattcattatcggtatcggatgctcgctaagcaatggagagaagcatgacggacgtgctccggactacgatgattggtctacgatcgccgagaacggacaaaccggattgaacggggatttattggtttgggatgatgtactaaaccgttctatggaactatcctctatgggtatccgcgtcaataaggaagccttgctacgccagttggatatttgcaaagccggggagaaaaaagaactctatttccacaaacgcctcttgagcggtgaacttccgcaaagtatcggcggtggtatcggacaaagccggttgtgtatgttctatcttcgtaaggcccatatcggagagatacaggcaagtatctggccggaggagatgcgcaaggaagcacgtgcggctggaatgatgcttatttagttaacagccaactattatattatggacgtaaagattgaagaaagctggaaaaaacggttagccgacgagtttgaaaaagattatttcaagcaattgaccgatttcgttaaacaagaataccgccaaggtactgtttatcctcccggtccttatatgttcaacgcttttgagcactgcccgttcgataaagtgaaggtcgttatcctcggccaagatccttatcacgagccgggacaggcgcacggactttgtttctccgtgcaggatggggtacctttccccccttccctcatcaatatattcaaagaaatacaagatgatttagggcatccggttccaacaaccggcaacttgattcgttgggcagatcaaggcgtattactgctaaacgccacgctcacagtacgagcgcatcaagccggttcccatcaaaatagaggttgggagacctttaccgatgctgttattcatcgtctggcggctgaaagaagccatatcgtttacatattatggggttcctacgcacaaaagaaaggtgctttcatcgattcatcccgtaacctggttcttaaatcagcccatccgtccccactttccgcttaccggggattcttcggaaacaagcatttcagcaaagccaatgattatttaatcgcaactgggcaaactcccatcgaatggtaagatcattgagaattgaaaattagctatacaatccaataattttcaattctcaattttcggttcttaataccactgctgtccatccctataattacttctcttatcatacttcaaatctttcaataaagcagagcttacagcgatactgaatgtataggatttataaggaccgaccggaacgaaactagccgtcatttgccagcagtgcaagttacgagttacgttacaagtcatataagagatcttcttagcgtcaaaatcataagtagcgttaaagttaaaacgccagttctttgtcggctggatatttccgttaaagctcaaagagtgagtcaaggcgtaatcatactccagtttagaacgattaaaatcaccataccgcaaactcaaaccataactaaacgagaggctccaaggaatcttggaaattaaatagccatcggcatctgtctcaccggtctctttctttttgcccaacagacggccaccactttccttattctcgccctctccttctccatccgggttcaagccatccggatctgcgttcggatccgtagaagccgattgattcccggatttatccgatgaactatcacctcctccaaacaacttcttaaacgtatcattgttaaatgtataggaaaaactggtactagtccctctcaaacgaccaataccctttcctgctttccaacggggaatatcgacacgccgcccattctcatcgtacgtataggtatcgaactgaccattcaagttcaacgtataactcttggataatttcaaacgtaaaccgacactcaagtcgctccacttaaatgaatccgccgccatattataactcatgcctaacgacagcttatcgatcagactaactttcttgaatccagtagagtccttatccgaacgcaccttcatctcgatattgttatttacgtcaaaactgatatttccttgttttcccgttcccggaacgccatacatattatgagcaaacggagaatacgtatattcacgatcctcaccattcgcatcttgatatacataagtctcataaaaaccaaaacgagaagaagcgaagtccggctgggcgcttaccgtaatagacggctcgaagcggtgacggatcatctcaaccttattacccaagaatggtaacggcttataaaaaccatacaaggtagtagacgcagagatagaagcgttaaaatcgtaaatacgataaaaaccatacgtagtgtcgcgggctaccaaagcctgtttctgcgtatcatattcctgttcgatcttgctggtgtaccaacgttccttataattgaaagagggagaaatattcaagtacttgagcacggagaatgtagcgcttaccggaatcgagtgctgcatagcattctgccaatctttgatcaaattcgatttgaataataagttttcctttgtcgtgatactattactgaacgtaccggaataactcatggagatcttctcgtaccaacgctccttcccgaccggatgcttccgcttgaaagggaagatacggctcatcgtaaccgtcatgctaggcaaggttacggcgatagaagaatcacgggtcgtctggtttatactcatcgtaccggagatcgtgaacgggttattcgggaaacgtttcgttacgttaatggatgaactcttcgtattctggttcacgtcggcatacccgtttgcgttcgggtataaactgttctgattattacggtcatacgaagaggtcgagaagtttacgctcgccgagaaagacagataaggattcgccttagggtcttgcgtatgcgtccagtttaccttgaagtccttagacaaattatagtcgggtaatcccttatcgcccaatttcgtcaccaaataagaagcattaaaactgcccgagaatttatagcgtttccgataagccgaacgggccgacaatccccaagatcccttggtataaatctctcccaacaaagccaagtccatataatcgctcaaggcgaaataatatccaccgtcacgcaagaagaaacctctggtagactcgtctccgaaagtcggcataataataccggatgaatatgtactcgagaacgggaagaaacagaaaggtaacccgatcggatacaacggcacgtcctccaagaccagatagaccggacccgttacgatattctttttcgggcgcaccttcgctttcgtcatctggatgtaaaagtgaggatgctcatgctcatcgcaagtcgtgtacttaccacccaccatgtttaagatatccccttccatctttttcgttcgcccggcggtaacatacccttcgccctgctgggtaatcacgtccgtgatatatcctttcttggtaccgaaattataccgcatcgtcttcgactcatattgctggtcgccctccttaaacaacggatagccaaactcctgcccgatagagtcgagtccaaacttagcgaacacgatgctactatccatattcatctcaatcaattcggattgcagctcgatattctggtatttgacatcgccttccccgtaaagatatgcccagttgccagctgtcatcacgatagaatcggtcgcttgataactgaccggagcatccagcccggtctgcttcttaggaatcgaatcttccgctaacgtagtactatccgtaggagccaccaagagagaatcagcctgcgccaagctatcggcaggagcgacaatctcctgcgcttgcacgcccaagcctcccaagaggaaaacgaatagaatgattaggactctatatatcaaaaacattacttcgttctttgcagtgtgttacagcgtgcaaatgtataataaataaacgagcccttatgcttttattcccctaaaaagagtttacaccagtgttcaaactgctcaactgtctcatttccatacttggataagctctgttttatcttatcagccggtttctctttcgtcaatttagtcttgctaaagaatttatcagcgaaacagatcaattgttcttccaatgacacaggacgcatatcacgatgtggaacaggcaggttccgttcctcgatcatggcaagcgaaagccccgtccccgtatgcctctcgcaaactaaggcgtggcgaggatacccctctttccgcattaaatcggctcccagatagccatgacagatataatcggcctccccatggcaatcgatatccggagcgttacacaaaaagatccctatgtcatgcaacattgccgcttcctcaataaaagtcagatccagattcatctccggatgcaaacgggccaatgccaatgccttatccgccacgctgcggctatgagtcaccaaaatccggtaggcatccgaactttccggataatatttctttattatatcaagaggtttcatcctatttatttttttgcgagacaaaaataaacaatctctctcacatatggatgagttcgcggaagatataccgcattggccaagtaatatatactacgttggcgatgttagtatgtattacttggcaaagtcagtactacttctcatcactgatacccctgaaaccaattgcccagcttcaaatcttttatatccgcacctgtttcccgttcgcctctcaaatactcagagaagtaatcgaccatccgccagtaataatactcattatagtcatcaaaatgatgacgttttcccggtacgatcaacatatcaaagcgcttgcccgccttgatcaactcgtccacgacaacaatggtattcgccggatgcacattattatcgatatcgccatggattaataacagatggcctctcaagttcctcgccaattcctgattggtcgggatgcgaatatcgaacgagatatttcccatatcatccgtgatctcctttaccccatgatgtttctctccccaccaccggttataaatgttattgtcatgattgccggcacaagataccgctaccttaaagaaatccggataaagcagcatagccgctgtagacatgaaaccgccaccggagtgtccgtgtatgccgacccggttgatatccatgaatttataacgagcgcacaactgctcgatagccactttatgatccgccatcggataatcacgcaaatttccatatccataattatgataccacttggagcgactgggatgccctcccctgtgtcccatgcacaccacgacaaatccggcttgcgccaaacgatccgtacgaggattcatcgggatgtagcgaaagaaagttccctcctgttgcggtccggggtatacatagttaatgaccggatatactttcgtggaatcaaaatcaaaaggcttatacatgacaccatacaaatcggtcaccccgtcggccgcctttaccgaaaaaggcccagggaatttataacctgccatgaataattgggagaagtcactctcctccaaggtcatcaatcggttaccttggttatcatacaatgccgtagccgggatcgtattgacacgagaatagttatccacgatatatcgcatggatttatccatagagaccaggtggaaataatcgcccggagtaatcagctttaagcccgaaccatccagattcacccggtacaaatgctcgtaataaggagtcgtatctcccttttcccgggcattcgctttgaagtaaacgacacgattcctactgtccacgtctacgatggcgtccacatgccaaggtcctttggtgatacggtttttcaaatttccttgcgcgtcatatagatacagatgcgcccaaccatcccgttcgctccaatggatcaattccttaccattatcggtcatcgctagcgggcgggtttccatagaggtatttagacgttcctcaatgatcgcttttaccgaatcctccccgatcgtatacgaacagatatccacccgtttcatatcccggctgacacgggtcaaatagaaggtctggttatctcccaaccagatcgagttccgagtgagtcccgtacgctccttatccggcttggaggctagattgattgtttgatctttaaaacaatccacccggatttctttccgcttcccggtattttccaaatcaaagagatataaatgaacgattggagaacccgcctctcccggcatctgatatttataggtctcaagtgtaggacgaggtttggcgatcgagttaatcacccataaatcttgcactgcacgttgatccgacaaagttgcggcgaaataacgaccatcgggagaccagttccccattacatatttccgcttatggtcacataaagtatcggtattcaagaaggtccggggcataccaaagccaaaatctttttcgccatccgtagtcaaggcgatctcggatatcgtcttatcctccgggtccttcacggccttctcataatcctcataactcatgacatacaggttcaaatctttcgcgaagacgacccgctttttatccggcgatatattcgcccaacggattttagcaggaatctcgtctttcgtaatccgagtcaaccgggaggacggataatcatacgagaaaaaatagttcccgttcgtaccctttatcgagaaagtaaacgtgcgatcatcttcctttaagcgtaaatcttcgataggaagttgttgtccggtaaaaggctctctcacgatctcgcttatctgtgccgccaactcatcccgatcgaataataatcgtttatttctcgaattggggtccaccagataccagtttgtcccctcactcgtcttatactcataccagaacttgtcactattattaaaataattgggggtaagggtataagagaaaagtagctgttccgcattcgacggggcgaaacggcgtgcttgcgtatattccggtaggacatcttgcgcataggtaaaaggcacccatgataaactcaagaaggctaccgcataaaaaagtgtttttacattcatagattcttagtattgtctgttattcgcctcaaaagtataaactttctgtgaaaaacatttcgtacttttgcggttagtatacagttattatatatgtaatgaaacagatctttatatttctagtcatactttttagcctgacgccaacggtctattcacaaaacgccccgttaaagctaggtgccgagcggatggatgtcgtcacccgtttgcttaaggataagcgggtcggattagtggtcaaccagacttccattttggaaaagcggcagattcatttattagatgcgctagtagcggaaggcatagacgttaagaaggtgttcgctccggaacatggattccggggaaccggtgatgccggagaggagataaaagatagccgggacttgaaaacaggtgtccccatcatctctatctatgggaaaaacaagaaaccgtccgccgagcaactgggcgacctcgacgtgattgttttcgatatacaagatgtaggtgcccgtttctacacctatatcagtacgatgcattacgtgatggaagcctgcgccgaaaacaacaaagagtttatcgtgttggaccgcccgaacccgaatgacttcgtagacggaccgatccgccagaaaggattcgagtctttcgtcggtgtcgatccgctcccgatcttgcacggcttgaccgtaggggaattggcatggatgatcaataaggaaggctggctgaaaagtgtgcccgatacctgccggttaaagatcgtaaagatggagaattggaaacacggagatccctattggttaccggtcaaaccctctccgaacctcccgaatgaccagtctatccgcctgtatccgtcgctttgcttttttgaggctacgaacgttagcgtgggaagaggaacctattatccgtttcaagtactaggtttctcggaccctaaatacggggatttcacttttaccccgacctccttgcccggattcgataccaatcccttgcaaaaggataaagtatgttacggcatcgatctgcgggaatatccgttcgaaggaggattaaccttgcgattcttcctcgacttctacaataaagcgggaaaggatcaagcctttttcttctcccgtccgaactggttcgatttattggcaggcacgaagcagctccgctaccagatcgtaaggggcttatccgagaaagagatccgggaaagttggaaacccgagctggatcaatacaaggccatgcgtaaaaagtatttactttatccggactatcctactcaaaataaaaaataagaacgaatgaattattgggaatcgcatacccaagtcgccgtacgtttccgccgattcgaccggaaacgttacgccgcgttccggagtatgcacaaagtcattaacattggagtcgtgacagcaagcacgttactattcgccctgcccgacacggcgcaagctcaaaagacaatcgagcctaaccggaccggcgaggaagcttccgtagagctggaagaggtagaagttaccgcctcccgtgcgcctatcgcacggaatcaagcgaccaagatcgtgacagtcattcccgcccgtgatatcgcggcggcacctgtcaccagtatccaagatcttttagaatatgccgcgggaatagacgtccggcaacgaggagaaggaggcacccaagccgatatctccatccggggagggacgttcgaccaaatagcggttctcttaaacggggtcaacctctccaacccacaaaccggccattatagttttgacctcccggtgaatctctcggacatagagcgcatcgaggtggtatccggcccttcttcccgtatattcggggccagcgctttcgccggagcgatcaatatcatcacgaaaacaggaaaagagaacaggatctcgaccgacaattacgccggaatgcataagctatggaaactggaagctgccatcaatcacgcgaccactcatttcggacagcgcctttccgcagggtatacctcgtccggagggtatatagacaatacagacttcaaacaattaaatcttttttggcaatcggaacttaaaagcgaggaggccgatttccaattccaagccggatacaacgacaaaggttatggagcgaatagcttctactccgcttcctatcccaatcaatacgacaagactcgccgcttcttcctctccgccggaggagaaatacatggcaaaatcaagttcacccccaaggtatactggacccgacatttcgaccggtacgagttgttccgtagtgatcccgccgattggtataccgggcataattaccatgagacggaagtatttggagccaacctcaacgccatgacacagtggaaactaggaagaaccagtatgggcgtggaattccgaaacgagggagtaaagagtaacgtattaggcaagccgatgaaggaaccgcaggatgttcctttcgagaaagaggggcaatatctaaaaagcgataaccgaagtaacatcagctactttcttgagcataacgtattattacgccgcttcacgttgtcagtcggggtcttggcaaactataattcggccttaaacgaagggattcatttctatccgggaatagatgccagttaccgtatcggggacaatttccgtctgtatgggagctggaaccgggcattgcgtatgccgactttcaccgatctttattatgagggtaagacgaataaaggaaatccggacctaaaaccggaggaaagcgaggcattcgaggtcggactgaaatacaacacttacttcctccgggctcatatagccggcttttaccgaaaaggcaagaacatgatcgattgggtgaaagagaaaccggaagatatctgggaaagccaaaatctgacaaaagtcgataaccttggtttcgagactaacctgagtttattaccgagggaactgggcaacgaacggttctttatccggaaaatagaactgggatatgcgtttatccatcaagacaaggatagtgaggggtatatatcgaattatgcgttagattatctgaagcacaagttcacggctcaattaagccattctatctggaaaggtttttcggccacttggtatgtccgttggcaagaccgggcaggtagttatactaaatacgagaatcttaagccggcttatgaggaaccttacgctccttattgcttagtagatatgaaagtaaattgggaatatcagcggttaaatctatatgcggagttaaataatctgctcaattccacttattatgatctgggaaatatcccccaaccgggtatttggtttaaggcaggattccgttatagtttcaaatattaatacccagttgtagagacggggcgtgccccgtctctacaactgggtgattttatttttgctttttgatcaccaacaacttatcattattggtcccgaacaaagcgatttccgtaacaggagccgcctcaccctgtgcctcaaagcgcaccaccttattaagcgcttccagcaactcacgctcgccgctcatatccgggcaagccattcgggtagtcgctacctgtgggaacttaatgatatttctataagcatcattatattcgatcttccccatcaaccgattgcaaccggcatttcctgaaagcccttgacgagccacgtcgaacaccaaaacctgatgagtctcctcgggattcaacgtcttaccgttcatctccacgacaccccattcaccatccagatccgagaaagaagctaccaccgctttcttggacttacaaccggcgaacaaaccgacgcctaccaaaagcaggcaaatataaaaaagaccttttcgcattaatttctctccaatactaataatacattaccatcttggtctaccaacaacatctcattctcatcttttccggccttcacggaacgaacctgatccatcgattgaagcacgctcgtctccaaatccatattcggacaagccatcatagtcgtagcgcccggagcgatcgtaatagaagatacatcttccggatctaacgtgatcgtcgtattgaataaattacagcctgtatttccatgtaatttcttctcagccatattgaagtccatctgcggcaggccttcttccaagactttctcacctttcacttctaccacattccatttaccttccaacttcttcacatctgtcttgacgtctgaacaagaaaacatcatcccaacgaaagcgggaagcaaaaacgcataaaacaatacctttttcatcttcatcataatcttttataaaatatctattgtaattagtaagacgcaaatagaaggcaaaatgttcccaagagcaccctgttttagcttatattaacagggttcttgattaacatcctctttttccacttctgcgttcgccatcgcaaacagagtaccgctcccctggaacactcgtccaaagcaaaagcgaaccacatccccgctaagcctaatccgaacacgataccgaacatatacccgcagaacacggcaaagaaccacatacagaataactcgataattaccgggaccacgacgtcgcctaccgaacgcaagcagaataagaacagcagtaccgtggcccgcccttgctccaagagtacatctaccagcaaggctcccatcgcgatcgttatgattgcttgattctcagtaaatatccccaataaaggacgtcccagcagataaaccccggtactagcgaccagcgtaatcagcaacgacctcctccaagcataccaactcaataaataagcggcttgcttctttctcgcgcccaccaaattgccggtacaaatagaagtagcttgcgcgatcgacaaagagaagatatagccgattatcacgatattcatcacataaacacgcgctgtcaagtactcattacccaacatattgatgaagtaaacgatcgtcacctgcgaggcatcatacgagatttgttccgccgccgaaggcaaaccgatcttcaacacgtctctcaacttctgaaacgggaacggacggaaataagccaaagggatacgaggcaccaaccgcttgaacagcatgataaacaaaagtgtcatcgccactccccggcaaacagaggtagagatagccgctccttgtacaccgagggcagggaaaccgaaatggccaaatatcaacgcataatttccaaacacattcaatacattgatcaacaaggtcacctgcatcgcgtaattcggcttgttcgccgcacggagcaccgccgatatcgtgaaactaaccgcttggaagaagccgaaccctccgacaatgtgcatataagtctcagcgtccggcatcagatccggacggatatccatcaggaccagcatctccctaccgaacaagaaaagcatcaagctgatcaagcaaccgattcccgcgttaaacagcaaagacgtccctaatacctgaataaaactcttattatctttcgccccgaaatagagggcgcacatgacggaagttccggtcgtggtaatattgaacagcaggaataccatgttcagcaattgattcaccacacctaccgccgccaccgcattatcggaatgatggctcagcataagcgtatccaccacgcctaaagtcaacatcagcaaggtttccagaaagataggccctgttaatttaaataatttgcctctcagccctctcggggcacggaatagtctatacatgtccattgatctgctttctacctaaacaccttttttacgagtccgcgaaggtacaaagctttacgctaaataggtttcgctatttctattattttccgtaagtttgtatccggttgaataatttttgatgaacaaacgaagacaaatggacaagaaactacctatatgtatcgtattagtcatgttgatgagttgtttctcctgcaaacagccccaacagcccacggaagacgcagacatggatacgcagtgggtggatagctcacagcatctgtatcaatacggcatctgtatcgattccttggacgtaaaagagtatttgatgaaaaacggggataatcccgcctccatcttctccgggctgggcttcacggccttgaaagcagacagtatcagcagggcatccacccatgtcctcgatccgacgaaactgcgagccggcatgcattattacacattttccacggtagattccttggagacgatccgatatatcgccttcgccaagtcgctgaccgattatgccgtaatcgacttgaccggcgatacgatcaacgcctatgaatttaataagccgatcaccctcaagaaaaaatatacggaaggagtattaaactcttccctatggaacgtgatcaaggccaacggaggtgatccgtatctggcgatcaagatatcggacgtgtacgcttggcaaatcgatttcttcgatatcaaggatggagactccttcaaggttctatacaatgaggcttacatcgacgataccaccgccttgagcatcgcctctattgagggggcgatctttacgcatcaaggcaaagagtttgtagcgattcctttcacccaagacagtatcttcgaatactttgatgaggaagggaacagccttcgcaaagcgttcttgaaagcgccattagactttttccggatcacatcccgttttacgaacgcccgtttccacccgatcctcaaacgataccgggcgcatcatggggttgattacgcagcaccgaccggtacaccggtacgcagcatcggagctggtacggttatcgccaagggatatcaaaacggcgggggcaatttcctgaaagtgaaacataactccgtatacaccacgacttatatgcacttaagccgcttcgccaaaggaatccaagtaggcagccatgtgcaacaaggccaagaaatcgcttatgtaggctccaccggactctctaccggaccgcatctagacttccgtgtccacaaaaacgggcaacctatcgatccgctaaaaatggaagctcccccttctgaaccggtgaaaccggcctatagggatagtttcgctttcgttaagcggcaaatcttggcggaaatagatagctttcatgtagccacagttagcaaagcatctgttatatatgagaaagatagtatcaaccatttaaataactagcgtatgaaattcttggggaatataatatggttactcttcggagggattataacaagtgtagaatatctgatatccagcctaatactaatgataacgatcattggtataccttttggcctccagaccttaaaattagcgatactggctttatggccttttggcagccgtgtcgtagacgaggggaattccggaggatgcctgtcacttatcatgaatgtgatctggatattcgtcggaggcttttggatttgccttacgcatctgggattcggccttttgctatgtatcacgatcatcggcatccctttcggcatgcaacattttaagatggcagctttagccttggcacctttcggaaagagcatacaataagggaacgtctgacttttctgtagaagacagacatccggcaagaatttaggctaggataaggtattatacctatttctttctatacctatacattctcgctccttattctatttcataaatcacggtatggtacgtacagaccacgccttggtttgtatagatcaagccttggtctgtagagttcacggcgtgatctgtagaattatactagatattcaaatgaattcatccgatatctttcaagtattcataaagaaggagggaagtataaatagcgttcatatacatctccctcatagggcctaggggcgttatagctcgatctgggaaaccgaaaccggagtattcatgaagatagaggccgcctcagaaaacttctctgccgactccgtggtaagaaaacggcaacttcctcccttcgtgagtttacgatccatttccgggtgacgccctaaataatctcgcaaactctccgctacatgctcgccttgcgagaatagagtgatgccggaaggaagaaaagcacggatcttatccatcaaaaggggatagtgagtacatcccaagataagcgtatcgatttgcggatctacggataatatatggtcgatatgctttttcacgaaataatccgctcccggagaattaaactcattattctccaccaaaggaacccacatggggcaagcctcgcctgtcacttggatatgtgggtacatcctgccgatctctatcgtataagaattggacgtaatcgtaccgctcgtacctacgataccgatatgtttagtacggctgatcgtatccactaactcaactgtaggacggatgactcccaatacacgacgattgggatcccatgtaggcaagtctttttgttggatcgtacgaagcgctttcgcggatgccgtattacaagccaagatcaccaattggcaacccgactcaaacagacgcgataccgcctgacgggtaaattgataaacgacctcgaacgaacgggttccataaggagaacgtgcgttatcgcccagataaacgtaatcataaccgggcatcaactgatggatcttatcgaaaatcgtcagtccgccataacccgaatcaaaaagaccgatcggaccgggagcttgtggaaacatatcagaacctttcttttataaagtacaaagggtgcaatcctttcggaaaacaccccctcttttattctatagaataaattttctcgctaattacaaaccgagtttcgtacgaacaaacggagttgcgtctaccgcgttagtacccgtataaagcaaagctgccggatcgatgatatacgtatatcccttctcctcgcctaccttctggatagcctcgtgcaacttctgttggatcggttgcaacaattcctgttgtttcttttgtacgtcttgctgagctacctgaacgaagttatccatacgttcttggatatcttgaatctcttgcattcttctcaacttgatattttctgtcaatgaatcttgctgcgctacgaagtctgaatatttcttttggtattcatcttgcatttgcttcaattcaactctatatttctcattcaagtctgccatttgtttttccataccagatacctccggcatagccataaacacctcttgagtttttacaaacgcaattttaacttcctgagcgatagctcccaacgggagaatcatcaacaataaaacaataagtttcttcatttttactatataattactttgttattaatcaagctttcacacttttcatgcataaagcgcacaaatgtaagcatttattttgaatatcctaacttaatcagcacttcattactgatatcgatcttcggagaagcgaaaataatgctcatagctgaagctcgatcccaaacaatttgatatcccttgtcttccgagatttctttcaccgcattatacacctcgtcttgaatcggtttcatcaaactctcgcgtttcttatataactcaccctcaggaccgaaatatttacgcttcagatcttgcgcctcttgctctttcttcacgatctcttcctcacgtttcgttttcatctcggcagagaggaataccagatcgctctgataattcttatacatattctgagcttcttgctgaatcgcttccacctcattttgccatttcttggaaacttggctcaactgctcattggtcatttcgtaagccggaatattcttcaatatatattccatgtcgattaaagcgaacttctgtgccatgccggcaaaagaacaaagcaacatcagacagctcaatgtgataatctttttcatactctctttatttatagttctactttatgactgcaaatataacagagggtttacttacagcctaccaatattcgttaaaagtatttatttaaatgtagagacggggcgtgccccgtctctacatacggaacacgccccgtctctacatacgaagctatacccgatctatattttagaattcctgtccgatgataaagtgcaggttactaccgctacgtttaccattagatccataattcggctcgtcgaaaccataagcccagtcgagtcccatcaaaccgatcatcggcaagaatatacggacaccgacaccggcggagcgtttcaagttaaacggattaaaattcttcaaatcagtccaagcgttaccagcctccacaaataccaatccgtagatcgtagaggaaggctccagcaagaacggatatctcaactccatagccaaacgagaataagcgtatccataagagttgtaaccaccattaccggcgatactaccattctcataacctctcaaaccgatcgtttcctgagcataggtactggagtaaccactcataccgtcaccacccatatagaaggtctcgaacggagacttcttatttttattataagtacctaagaagccatactcaacacgggtcatcaataccggcgtacgtttcacggtcaacggagccaacggagagaagatcttcgctttgaacttccatttatgatactcgatgaatttatacttatccgggtctgagcttgacatcgacgcataatccttaccatcgaataaagagtaaggaggcgtagcagctacagacaacatgaattgtgaacccttacgagtatacaacgggttatcgatagagttacgttgcaacatcaactccaagttgatattatggcaatttccgttattaaccaagaaatagtcccaatcatgcatcatatacaactgatagttcaacgtcgccatgaactggaagtagtcgtccggccaattcaaacgtttaccataaccggccgctaaaccgaacatcatgatagacttatccgggtcgtaagcatactcataactattattgtaaccatagttgccgtaatagttgctaccatagccataaccgcccccataataaccgggataaccatagccatagcccggatagccataaccataaccggaattggtcaagtaattgctactgatatcggtttgctttgagaaataagcgctgacagacaatgtattcggtcgtttaccgccgaaccaaggatccatgaaggagatgctgtaagcctggtagtaacgcccattcgtctggccgctcaaggtcaatgtctgtccctcaccttgcgggatgatgcccttataggttttcgggtttaagaagttcttcatagagaagttcgtaaacttcaaacttaacttaccgatcacacccgtctgtccccaacctgcggagaactcgatctggtcattcgccttggaaaccaagttatactcgatatccacggttccattctcaggatcaggcagcggcaccggattcatgttttccgggtcgaagtgtcccatctgggccaactcacgaacggaacgcatcaaatcctcgcggctgaacaacatacccggcttcgtacgcaactcacggcgaacgatatcctcatacagacggtcattaccattaatgataatacggttgatcgtcgcttgcggaccctcttggatacggatctctaacgagatagagtcattcgctacatccacctctaccggatcggcgttgaagaacaaataaccgttattaaaatagacattcgaaacggcatcctcatccgtactcaaacgttcgttcaatttcttttgattatacacctcgcccggtttcatacccagcacggccatcaaatagtccgtagaatattgcgtattacccacgaagcgaatatctttcaaatagtatttctcaccttcatccactttcaagaagatatctaccttcttctcgttaaagttcgctacgctatcggacaacaatacggcgtcgcgataaccatgctcgttatatttagcgattatatttttcttatcgttctcatattcctcagtcgtgaacttcttcgtgctgaacatctccatgatactggttttccagtcgttcggcaagctgaacttctcgttcgtcttcttcatcgccttcttcaactcccgggcggtcagtttttcgttaccctcaaaatagatacgatggatcttggtcttttcattcttatcgatattgatatccacgatcacctcgccttcattcgcgggatcgtccttttgctcgatctcgacatccacgttcttaaagcctttgccatcgaagaacttctggatcacgatcttggcacggtccatgacgttcggcgtcacctggaaacctttcttcaagcccagcttcgcctccaagtcctcacgctcgcctttcttgatcccgtggtaattgacttgcgagatacgcggacgttgcttcagctggatctccagccaaatctggtcgccctcgatcttcgtcgccaagatcttcacatccgaaaacaagccatgtttccaaaaacgcttcactgctgtagtgatctcctctcccggtacggtaatctcatcgcctaccgacaagcccgagaagccgatcaacacaaaatcatcataattcttgatacccgtaatctttatatccgcgatcttgtatttcttcgcggccaacgagtacgaaatgaccggcacttctgccggcgcctcaacttgggtagtgtctatttcttgggcaaacgcaccgcaagcgaaacccaagcaaataaaaaacagcactattcttttgtacatataacagctattgtttataagattaattgctcacttgtcttaccgaaacgacgctcacgttgctggtaatacaatatagcctcatacaactcttcttctctgaaatccggccaaaacacatccgtaaagaagaattcagcatatgacaactgccatagcaagaagttactgatgcgtttctctcctccggtccgtatcaaaagatcgggatcggggatattcttggtcgtcaagtggtccgagaccatggcctcggttatatcattggggtttattttctgttccaagacctcttgggcgagttgcctagccgctctggtgatctcccaccgggaagaataactaagcgccagaacaagtgtggttcccgtgttcgccgaagtcatatcgatacattcttgcaatgtattatatgcatcctcacgcaagcgggagaggtcgcctatggcggtaaggcggacgtttttcttcatcatgtccggagtctcccggtgaatggcggagaccagcaagctcatcagcgcttggacctcttcttccggacgattccagttctcggtagagaaagtgtacaacgtcagatatttcaatccgagttgagtgaccgcatccataatcttacggaccgaaacaacgccttcctgatgcccgaagctacggtctttccccttcgccttggcccaacgtccgttcccgtccataataattgccacgtgccgtggcaagcgattcttgtctattttctcaatcaacgacattttttatcttactaatattcacttatatttttcgcattgttacaagtacggcacctcgggccgaaatcccatgtaacagacaacaacaagaaagagtaccaatctttattcttaagagcgctactcttaacaccatacggatcgtccaacatgtcctttccctctaggccatcgccaaataacttacgaaacgagaactcgcaccctaaattaaggcggttcttgatcttatatttcatgcccacgcctaaaggaatattcgggctggcgaaagtcttcccgccacccggagccaccgtcagcccaatgcccaccaagacataaggagagaaacgcttcgcccccgcatagtcgaacttatcgctatacgggaaaaagttgaactccgcctgtccccccaactccatgatactacggttgaaagaggtttgggcattattcggaaaaacgttctccataccttcggtcttaccggaaacctgtccccacatcaagttggctttcaaggcccaacgaaagttgatgttataccggaacacggctcccaccgccggattcattcctttaaatatcgtattcttgttggcgtcgcccatataaaaggcgccaccagccataccaccgatctcgtacttatattcctgcgcccaaagcgtagggaccgtacccgctaataggatgattatgagaagccgctgaaaaaaagttgaagtcataagccttgctgttatatataccacacttctttttctaacgctaaaagcctcataaaattatacatctcctatcgaacttttctattccttcgggatcaaacgattgatacggcctctccaaagttggttcaagtcattggaaccagtgctggtctttcctccgaaaatgttcacgaaattctctttatccacaataattgaggaaaagcctctcgccgcatagtcggtcggtaacaccaccatcgagtcgatcaacgaccaagaaataccataatctatcgattgatacatatctttcaatgccttgttcgaagcgtcgatacctccgatcaagaaaaacttatcgtcataattcgtgatcatcgctccctcacgcttcgtgaagtttgcgtcaccagaagccatcaacgcccaagagataccatccatggtagcccaagtcgtattaaccacttggttgtccacggtacgtccgctggcggtcatcaagtactcatgatacattgcggcatattggagattgctaaatccggtaacagggaatccgctaggcaccgcatctccggcgatccactccatggattcgttcatcgcatagaacgctagctttccttcctgatccacgatcgtagccaaggcggaaggctgtttcgtgccctgcttcacgctacccaaaacgtatttcacggaaggggcgttctctacagcgctccaagtcaagccatcctcggatctatataaagtgccatttgtagccggcacatataaagctttgttatactcagtaatctgggagatcaaaagcccatcggaaggcagaccggtcaaggataatggctgccagcccttaggcgcgcttaccggagcgtaatataattggtaaggtttaccggactcggcgggtttcacatacataaagtaattctccgatccattataatcgtaggttaccaccttctgatccttcacggtaatgccaatcataggattcgcgtacatactccaaaccatagagtccggaaccacttgatggatattcacttgcgccatatagacttttgtcgtgacttggtcatacgcatgaaccacgaactttaccggagcggagaaatcgatggaatccgacaaactacttaaataataagtggaatcgggataagcctcgggactagcctccacgccacctatcactgaagaattagcgaacccaatcttacaaaccactttctcgatcttcgtaccaaaaggtaaagagtctatattaaaaatccgtcccgttagctggtctatcgtaaacttcacagtatccaaccccgacacagaatcatgacttaatgaaaaagtatgtatctggcaattcttaatagcttctacaccaacgatttcatctgacttcaaacaagaagacagcactaacgcaaaacaacctgttataaatagtactaatttatttttcatcaaaaacataagtttgtcgcatataaaggcacaaaagtagaaacattttttgctttcaccctaatacctgctaatatttataatattttagttgattatatgagccttaaaattcatagttatgatttttcgaactcatcgttatgatttaaaatttcatagttatgatttttaatgctcataacagaacctcgagagacacgcctaacaacccccttttcaagcatcggcgcatgcaccccttgatacaggcgaaccggagctgtttccaccctcgcctcgtcccacacatccgcttccacgaaagaattaatcagctgagtcccaccttccaccaataaggaatccaacttccggacagcaagatgatctaacacttgccggatcaccggaccctcgaaatctatccggatatactccacgtcctctcggttttccacttccttctccgtaaatattaatgtacgcaaggaaccatccagtaaccgataagaatcgggaataacgagccggcgatccaatacaaccctaaccggagaattaccggaccaatggcgcacgttcaatgaaggattgtccaataaagcagtccgtgtaccgaccatgatagccgccacctccgagcgaagtttatgcaccaagcgggaagtctccggagaagacaaaaccgtgaccggctccaacacgtccatacgtaaacggtcgataaacccatcctcactctgcgcccatttcaagataatataaggacggcctttcgtttgtagcgtcataaacgccttgttcaacgcacgggcttcttcctccatcacgcctgtgactacctcgacaccggcctcacgcaacatccgcacacctcgccccgacacctcgggaaaaggatccaagcaaccgaccaccacccgtggaatccctttccggataatcaactcggcgcaaggaggcgtcttcccataatgagagcaaggctccagactcacataaatcgtactgtctttcaacaaagactcgtctttcacggaagcgatagcattcacctcggcatgcgcctccccacatttcctgtgaaatccctcaccgataatacggcccttatgcacaaccaccgcaccaaccatcggattcggactgacatttcccctccctcctttagccaactcgatgcaacgagccatgtatttctcttcaacctctaccataatctttgcatataaacggtttttacactactttcgcgataaaacaagagaaagatatgactgagaccgtcgcttacatccgaaattccctcaaagatatttatcctcccggcgaagcccaagcgctcgtccggctcatcatggaacgtgtttgcggtctttctacccatcaactcctgttaggcaaaggtaaagaattatctgatacggagaaatttaaaatcaaggagattgtagaaggactgcgtttatacaagcccatacaatacttattaggcatagcggatttttacgggatggagtttaaggtgacgccggacgtattgattccccgcccggaaaccgccgagttggtcgagcggatcatcacggactaccaaggccaagcccctcgtatattagatatcggcacgggaagcggctgtatcgctatttccttggcgaaacatcttccggaggcagaggtagcggcggtggatatatcacccgaagcgctcgccgtggccgaggagaacgcccgtatgaatcaagtttccgtatccttccatgaattggatatcctttccgaaggttattccagtttcatgcaagagaaacaaaattttcacgtacgtgaaactagattttcatgtacgagaaacaaaattttcacgtacgtgaaactaaaatcccatacggaggaaaccgaagcgtctcttataggaagcttaaactgcatcgtcagtaatcccccttatataatgtatagagagaaagcgaccatggaagcgaacgttctggagaacgagcctcatctagccttgttcgttcccgacgacgatccgcttctcttctaccgggccatcgcccgcttcggacaaaggcatttggcggaaggcgggcatctctatttcgagatcaacgccctttgcggaaaagagaccgtagcgatgctacgtcaagagaattacaccgaagtcgaattaatacaagatttatacggaaaagaccggatcgtaaaagcaaaaatatgaaagagataaccgaacccgagatgttgcaccgggcagccgcctattgctccgccgccgaacgctgcatacaagacgtacagaaaaagatcgatgccgccggacttcccccgacgcctccgagcgtatcatcgctcgcttgctgaaagagcggtttatcgacgaatcccgttacacccgtttcttcgtgaacgataagctacgattcaataaatggggacgggtaaagataggctacgagctttataagaaaaacatcccctccccgatccgggaagaatcgctcgccgccattgacgagggagaataccgctccatcttactcgatttactaaaaagcaaaaagaaatcgacaaaaggaaaagacgagcgggacctattcaacaagttactccgtttcgccgccggacgaggtttcgaaagccggatcacgttggattgcctaagccaattattcaaaggaacagactgcgaggattatgccgacgacatggaataatctgctcaacctgtttttcccaaacttatgtaaaatatgtaaacgaccactcgtcgagggagaagaacaaatttgcctgaaatgcctatgcgacctgccgcacacgggatatcatcaacaggcgaacaaccccgtcgagcaactttttatcggaaagaaccggatcgaatatgccaccgcttatctacgatacgagaaaggcggaaaagtacaaagcctgatccactcgctcaaataccatgataataaagagttgggctatctactcggacggcagatagcgagagagctccaagcggatcacagcccgatatgtaccgtagacctccttatccccgttcccctgcatccccgcaaaaaacggcaaagaggttacaaccagtccgaatggatcgcctccggcatccgttccatatgggatatccccatcgatacgcaaagtctagcccgcaccacccacacaagtacccaaactcgtaaggccatttacgatcgttggttaaatgtatgttctatttttaatgtcattcatccggaaagcttaaaaaacaaacatatcctgctcatagacgacgtgatcacaaccggagccacgatttccgcttgcgcaaaggctttatcagggattccgggcatacgcatcagcattttagccctgtctgtcgcataaatattaataaaaaattaacgtacgatattcaaggtaatgtcattcagtttatctatttttgcagactgatataaatataggattgtatgaaaacactggaaagtttagtagcagaaaaattattaaagattaaagccgtaaagttgcaaccggccaatccgtttacttgggcatccggctggaaatctccgatctacaatgacaaccgaaagactctttcttatccggtcgttcgtagcttcattaaattggagttggctcgtgtgattagtgaaaaattcgagaacgtagatgccattgccggtgttgctacaggcgcgatcgctcaaggtgctttagtagccgatttattaggattgccattcgtatacatccgctctacgccaaaagatcatggattggaaaaccttatcgaaggagaattgaaaccgggttctaaagtagtgatcatcgaggatttggtatctaccggaggtagtagcttgaaagccgtacaggccgtacgtaactttggttgcgatgtcgcgggtatggtagctatctttacctatggattccctgtagcggaagccgctttcaaggacgctaaagtaacattgactacattgagtaactacgacgctgtcttggaagaagctgtccgtacgcattacatcgatgagtctgagatcgcggttcttcaggaatggcgtaaagatccggctaactgggacccgaaataagtaataaacaaaaagacactcaatgactgaagaatttgtgagtgaggtcaaacagatcccacacaatgatgaacgtatcttcacgatgttgtccgatctttccaacttggaacgtatcaaggatcgcatcccgcaagataaaataaaaaattttgagttcgacagcgatacctgtagtttcgctgtcgatcccgttggtaagattaccttccagatcgtagaaagagagccgaataaattaatcaagttcacgacgaccaactctcctgttccccttttcttatggatacaattgaaacaggtggccgaggacgacacacggttaaaaatcacggttcgtgccgatctgaatccgttcttgaaaccaatggtatcgaaacctttgcaagaggctgtggataaaatctcgaccgttatcgcctccttgccttattaattcctttttcattatggctcagaaactttgggaaaaaaatgtacaggtagatcatgaagtagatatattcacggtaggtaaggaccgtgagatggatctttacctcgctaaatatgacgtattaggctctatggcgcatatcacgatgctggaaagtatcggtttgttgactaaagaggaactaaacgtcttattagcagaattacggaatatatacgccgtagcggatcgtggagaattcatcatcgaggaaggcatcgaggatgtgcactcgcaagtggaactcatgcttacacgtcgtttgggcgatatgggcaagaagatccatagcgggcgttcccgtaatgatcaggtcttattggatctgaagcttttcacccgttcgcaaatacaggaattggttgagttggtttccggcttgttcgacgttttgatctcccagagtaaccggtacaaggatgtactgcttcccggatatacgcatttgcaggtagccatgccctcttcgttcggactttggttcggcgcttatgcggagagcttggtagatgatttgcaacttatgcaagccgcataccgtatttgcaaccgcaacccgctgggttccgccgccggatatggttcatccttcccgctaaaccgccagatgactacggatttattaggtttcgactcgctggactacaatgtggtatacgcccagatgggacgtggcaagatggaacgcaccgtagctttcgctatggcgggtatcgccgctacgctctccaagttggcgttcgacgcttgtatgttcaatagccagaactttggcttcattaaactgccggatcagttcacgaccggctccagtatcatgccgcataagaagaatccggatgtatttgagttgacacgtgccaaatgcaataagcttcaaggcttgcctcagcaaatcatcttgatcagcaataatcttccttccggttacttccgggatctccagatcatcaaagaagtcttcctcccggctttcgacgagctgaaggattgcttacgcatggtaactcatatgatgcgtgaggtgaaagtgaacgagcatatattggacgatgataaatattctctattgtttagcgtggaagaagtgaaccgccgtgtcttggccggaatgcctttccgcgacgcttataagcaagtaggtttggatatcgaggccgataaattcgttccttcgaaaagcgtcaaccatacgcacgaaggtagtatcggtaatctatgtaatgaaccaatcgccgccatgatgcgtagcgtgataggttctttctctttcgaacggatgaacgaggctgaaaagaaattgatccatggataagataagacggatatttccacttttgatcttgtttacgctattatcttgcgcagacacgatagagactcgcattccctatcgtgcggtctatctggaactagatctgacttatcaagataaagcgttgaatgcaatacaggcttataagatctacacctctaaagatgtagaccaagctggcgagcaaacaggttttggaggcgtattggtctatcatggattgtccagtaacggaactggagcattcttcgcattcgatgccgcttgtcctcatgaggcatccgctaatgtcatcgtagatgtggacgaatctgccgtatacgccatttgtccgaaatgcggtagtaaatttgaacttttaaacggtatcggcaatccggtggaaggaccttgcgctgaggagaaacaagccctcaaacaatatgtcgtcgatacaaacggtaataaaatttacatccataattaaatttttcaccggaaatgtttggtagtataaatatttgtactacctttgcactcgcaaaagagaaacaaacaatgcggaagtagctcagttggtagagcataaccttgccaaggttagggtcgcgggttcgagtcccgtcttccgctcaactcttagagaagagtggatgctcgaatggtggaatcggtagacacgaaggacttaaaatcctttggccattgcggctgtgcgggttcaagtcccgcttcgagtacgatctaatttaattgcggaagtagctcagttggtagagcataaccttgccaaggttagggtcgcgggttcgagtcccgtcttccgctcgcttccaaaaggcctcgctgttcgaaagaatagcggggctttttatttctaaaatataatcgtatctttatcttcaattaaagtgagggttatggaattacgtactgcgaatgttacccgatatatcatgcctctgcgggaaggcggatcattgcctgctttagcggaggcggacgatgagtttaaatatgtcgttaagttccggggagccggacatggggcaaaagccttgatagccgagttgatcggaggtgagatcgctcgttgcttgggtttccatgtaccggaattggtcttcctgaatcttgacgaggctttcgggcggtcggaaggtgacgaggagatacaagacttactacaagcaagtcaagggctcaatctgggattacattttttatcgggagccttgactttcgatccggtagtcaatcgtgtagatcccaaactcgcctcacaagtcgtatggctcgatgctcttttgacaaatatagaccgcacggtccggaatacgaatatgttgatatggaataaagaactttggctcatcgatcatggagcttccttatttttccatttctcatgggtaaattggcaaaaacatgcgatcggccctttcatccatatcaaggatcatgtattattgccacaagcgacgctgctggaggaagtaaacaaggatttcaaacgtatcttaacggaagagaaaattcgtgagatcgtaggtctagtacccgacgattggttgcattggaacgatagtcccggtacgcctcaagagatacgtgatgtatatatccggttcttaattgaccgaatcgcccattctgacacgtttataaatgaagctcgacatgcaagacaaacacttatatgaatatgccgtaatccgtatcgtaccgaaaatcgaacgggaggagtttatcaatgtaggccttatcatgttctgtaaacggcctaaattcatcaaggctcgctatcatgtaaacgaggagaaacttcgtctgttcacatcagatatagataaggaatctttgtgtacgaatctccacgttttcgataagatatgttccggcgcaaaggatggaggtcctatagccagcctagatattccggagcgctttcgttggcttaccgccataagaagtgcctctatccaaacctcgcgtccacatcccggtttttccaacgatctagaacagacatttgagagattatttcaagaattagtcttatagataataaacataaatctccgtatcacgataaaagaaaaaagacggatcgtccaaacaacccgtctttccttatagaactaatagatattatacttatcctcttaagtccgcatccatagcggcggcagccttacgaccgtctcccatcgccagaatcacggtagctccaccacgaacgatgtcaccaccggcatacacatcgcctaaagcggagcgcatactgtcttcctccactacgatcgtacccttcttgctcacctccaagcctccaaaggcacggggtattaatggattcggagatacaccgacgctaacgatcacctcatccacatcgattgtttcgatagctccctcgataggtaccggacgacggcgaccagaggcatccgcctcacctagctccatcttctgcaagcgcatctgcttaacacgacctctttcatctcctatatattcaatcggattatgaagcgtcaagaactccacaccttcttccttcgcatgtttcacctcttccagacgggcaggcatctcctcctcgctacgacggtagacaatcatagcacgctcagcgcccagacggcgagcggtacggacagagtccatagcggtattgccacctccgatcacggccaccttcttcccttgtagcaccggcgtatcactttccggattcgccgcatccatcaagtttacacgggtcaaatactcgttggacgacatcacgcccacaaagttctcacccggaatgttcataaaattaggcagaccggcgccacttgccacgaacacgcccttaaagccatccgcatgcaaatcatcataactaatcgtcttacccacgatacaatctttctcaaaccgtacgcccatcttacgaaggccatcaatctccacgtccacgatcttattcggtaggcggaactccgggataccatatttcaatacaccaccgatctcatgcaatgcctcgaacacagtcacatcatatccacgcttcgccatatctccggcaaaagacaatccggcaggaccggaacctaccacggcaatcttgataccgttcttctccgcaatctccggaaccgagatattaccgctctcacgttcgtaatcagcggcgaaacgttccaagtagccaatggcaaccgcttccttacccattttcaaatggatacacttgctctcacattgtttctcctgcggacagacacgaccgcaaacagcgggcagggcacttgtctctttcaaggtcttagcggcctccaagaattccccacgctcgatattcttgataaaagtaggtatattgatatttaccggacatccctgcatacaagtaggattcggacaatccagacagcgctcggcctcttgcatagcctgttcttttgtcaagcctaagttaacttcctccaaacgggtacgactccggtattccgggtccaactcgttcatcttcacacgggggatatccgcacgttctttatttttcttgcttttgcgaagcgcctcccgccaaggttcggcacgacgagcagcgattaattcttctgttgtcatgattcaattacgtggtttcgttatttcttctctatatccttataagcgccgaggcgcatgatcatctcatcaaaatccacttgatgagcatcgaactccggtccgtccacacaaacgaacttggtcttcccgcctaccgtaatacggcaagcaccacacatacccgttccgtccaccatgatcgtattcaaggaagctacggtaggaatctcgtatttctttgtaagagcggaaacgaatttcatcataatagccggaccgatcgtaacgcataaatccaccctctcccggttgatcacgctctccacgccattcgtcaccaagcctttcataccatatgatccgtcatcggtcatgataattacctcatccgagttttggcgcatctgctcctcaaggatcaccaagtccttggtacgggccgccaatacgacgatcacacgatttcctgccttatggaaagcctccacgatcggcaacaacggagcgacacctacgccaccaccggcacaaacaaccgttccaaccttctcgatatgggtagcctgccctaacggacccaccacatccgtgatatagtcaccctcgttcaattcacagattttacgggatgagccgcctaccgcttggatcaccaaggtgatggtacctttctcggtatccgccccggcaatggtaagaggtatacgttcgcctttttcgccaaccttcacgatcacgaagtgaccggccttgcgggagcgggcgatcaaaggagcctcgacttccagcttcaccacgttggctgagaaatgttctttacttacaatcttattcattataatcgctactgttgatagtttgtcttgttttgctggcaaaaataagataaaaaagtgaatatagccctattttccttaacaaaaggctttattcaaacaaaccttcatcacgcactaacatcaaaatagcggaatgaggaacaatcaagaacttctcgtcattaaaattgatctcgtaagcggcattctgcaaatagacagccaaatcaccttcacgggcttgaagcggcaagtattgcacctcctcccctttctttttctcccagacctcatgctcctcagattgagaaggcaacggatatccgggccccgtctttatgatataacccgcttgtatcttctccccttgttgaaccgagggaggcagatacaatccggtcttagtctggctctgtggattcttaggcttaatcaatactttatcgcctatcatcagaaatttatcgatgtctttttgatctatggatagttgcatgattataagatgttaaatttttatttcgcgaacttacggaaagtttaccgaacaaaaaaccctgttcgttgaataaatccgctcgttcacagattatattttcctaagtttttcccttgatttacatttacaccgttagaacttgtgaaagccataacaatccggttcatcatacagaccggcagaataggtaaacattaaggaaaagggcactttcgggtgccctttctcatttatccccatcagaaaacaatcggattctatcaaaagttgttcaccgataaaaaacacgatttcacagaataaatccgcccattcactgacttttattgctcagactctaaacaaactttaatattgaacctagtttactatactttattaacctattttattatgaaacacagacatgcgatctttagaagcaggctgggactagctttatgctttatgttggcaggcggtgctatcataccgcaaagttccgtattaaaagcggaaacctccgttacgcaacaatcccggaaaataacgggtacgatcaccgacgctaaaggagagcccctattaggtgttaacgtagtcgtaaagggtaccacgaacggaacgatcaccgatctggatggtaaatacgtattagaagtagagccggatgccattctggtcatctcttacatcgggtacgtaactcaacaaacacctgcaagcgggaacgtcatgaacattaccttaaaggaagacacccaaaatctagacgaggtagtcgttgtcggttacggtacccaacagaaaaaggacatcacaggttccgtagcggttatcgatactgaagagctattggcgtcttccggttcttccgccacacaacagttgcaaggtaaagcggcgggcgtaaacatcggtacctctggtgctcccggttcagccacgatggtacgcatccgaggtattaattccatcaatgacaacggacctttgtatgttatcgatggtgtatccactcgtgaccaagacctaagctctatcaatcccaatgacatcgagagtatgcaagtattgaaagacgcctcctccgcagcgatctacggagcgcaagcagcgaatggcgtcattttgatcacgaccaagaaagggacaaaaacgggacagccgagattaacctatgacggatattacggtttctctaaaacaggtaaacgctatgacgtcttaaacgcttatgaccgtattgatgtcgaatggcaagcctcgaaaaacaatctggacttaacaggagccagcgccaatggagaattaccttaccaccagcaattcggaagcacttccgactcttgggttaatcatctacccaattacatgaccgtaaccggcgccggtggtagcacctccatcgatcctagcgattacgatcaagcgaacaacgtagtctatgcgcccgtaggcgatacgaactggtgggatgaaatcagccaactcggttggatgcaaaatcaccagttgtccttgtctggaggtaccgataaagggcaatacaccatgagcatgaactatttcgaccagcaaggtaccgctatcgaatcttatttcacacgctatcaagcacgtgctaattcatcgtataacgtccgcccatggttgcgattcggagagaacctaacttatagttttagcaaaaacaacggacttagcttctcaggtacagagtccaacatctactcatggacttatcgggcctctccttatgtaccggtttatgactatgcgggcaattatgcaggctccttattcgccgggaccggcaatttccagaatcctgtagctattcgtgaaagaaataaggataattatgccactacccaacgtgtatttggcaacgtgtatggagaagcagacctatggaccgggctgacttttaaaacaaacttcggtatcgattatcgtaatgattattcttactcgatgaccaagaacaacccggagttctccgagtccggtggccaaaataatttctacgaaagtaattacttcaattatcgttgggtttggaccaatacgctatctttcagccggacattcaatgagatccattccttgaacatcttattgggaacagaggctattcgggatggtttaggcagatccctcaacgcacgtagatataactatttattcgaagacaataccaatacatacaccttggatatgggcgagaacaatagccaacgtaccaactcttccacttacaatggagaattcgcgctatttggtatgtttgcccgtgcagactatggatataaggataagtatctattaactggtattatccgccgggacggtgtttcccgtttctcggaaagtaatcgttacggagtctttccttctatctccgccggttggcgtatgtcagaggaggcatttatggaaccaagccgagattggctggacgacttaaagatacgagccggttacggcgtcacgggtaactcagagattcctgtcgcgactaatttcgctaatttgttcacgaccagcacctcctatacgaattacgacatgaccggagcgaacaatagcgagacaaccggattccgcctcagtacctacggtaacactgatacgaaatgggaaatgaccaagatggtcaacttgggtctggacgcgaccttcctgaatggtaaattcagcggttcattcgaatggtatacgaagaagacatccaatatgttgatacaagcggcctacacctcgatggccggagaatccggaagcccttatatcaacttcggagatataaagaacactggtttcgacttcatgtttaattaccgtgaccgaaaaggagactgggcatgggatctatccttgaatttatcccattataaaaatgaggtcttgaaactcgcggaagctgacgattattctctatgggctagcggtacgcgtatcgaaggatacgtaacccgtacgacaaaaggacatgccgtgtctgaattctgggggttgaagcaaaatggtttttatgagtccgtagccgatgttatggcaaccaagccatttggacaaagtgatatcacagaggcagacgctgccgcttatgtcggccgcttccgtttcgaggacttgaacggagacggcaaattggatgatagcgaccggacctttatcggctctcctcatccggacttaaccggaggcctcaacgccacgttaacatggaaaaactgggactttactatgttctggaacttctctatcggcaatgacttatataataacacaaaatattttaccgatttctggactttcaacggtaataaatcctcacgcctcagagatcaatcatggacattgaatggcgataacagtaatgctatccttcctatgctgaatacggaagataactattccggagcttattctagctcttattacgtagaagacgcctccttcttacgcctgaaaaatctcgtattgggatattccttgcctaaggaattactcaagaaggctggtatccagaatcttcgcctgtatttacaagccgagaatatccttacgatcaccggatatacaggcttggacccagagtttaccaacgcctatttacggcaaagcgattctgacaccgacggagccggacgtgtagacttaaaaagaggagtcgatatgggaggctggcctacaactatgcgattcttattgggcgtgaattttactttctaaatccatttactataaaaacgactattatgagacataaaatattaatagtaagcgcagttgctttatttaccttgagttcttgcggtgaggattttctatataaagctcctcaaggcagtattgaccaagaagcattaacaaatgctgaaggggttgagttattggtggtcaacgcttatgccggtttgacccggccgaccggatatgacaatatgttcaactgggtattcggcggtgtatacggaggtgacgccaataaaggctccgaatccaatgaccaatccgtattgaactccgtagagacgtatgctgtcaccgccacaaacgattatttactgaataagtggaaagacgcgtattatggagcacaacgttgcaacttagcgctcaatgtgatgaaagaagcggcagatatggacgagacgaccaaggccaaccggaccgcggagctgaaattcttacgtgccctattcatgttcgaaggggtaaagattttcggaccgaccggcatgccctatatcgatgagacgatcgccgctgaagaaaacgatccgaaagttcataacggtacggatatctatcctaatattttagcagacgtagaagcggccattgaaggattgcccgaaaaacagaccgaagtggcacgtcctacgaaaacagcggcaaaagcgttaaaggctaaaatactgatgcagcaaggtgatatggcagccgccaaacccatcttggccgatattatcgcaaacggattaagtcctaaaggagagagattggccttacaagatgatctggacgcaaattttaacgcaactaccgaaaatgggaaagagtctatctttgaggtacaattctctgtcggagccaataataacgggaattacggatttttactgaattatcctcataacacaggccccggtggatgttgcggattttatcaaccctcttacgaattggtaaactcattccaagtagacgaaaatgggcttccttatcttgagggagagtacagaaataaaaaatccgtgacagaacgtgttaccgattatgattacatctctaagaatgataagacgatcgccgtagaccctcgtctagatttcgccgtaggacgtatggagattccttataaagattggggattgcccgctaatgattgggtacgaaatgtaagcagcggtggggtattcctacccaaaaagcatgtctatagcaaagcggaacaggatgccggattagctggctccacctattcatccggctgggctcccggttctgccatgaatttacaatatctatgcctacgtgattgtaaattgttatatgcggaatgcctagcgaacgacggagaattaagtgccgccatgcagcaagtaaacgatatccgtgaacgtgcagccaaaccggacaatatcatttatttggaagacggaacgcctgccgccaattatttggtgaaaccttatccatccagtcacgccgcattcagcaacaaggaaacttgtatcaaggcgattcatatggaacgtaagctggaacttgcgatggaaggacaacgatttttcgatctggttcgttggggaggtgattatatgaacaaggaattgacggcatatataaattatgagaagcaatacctaactaaattctatggtgtatccgctccaaccgcttctaagacgatgttcccgattcccgagacagagatccagaccgcaggaaacgatgagaacggccaagcttatctggtacaaaatgatgcttggaaatagtccaatctcatccttcttataaacagaaaggcgggcttcccgaaagaaagtccgccttcacgattctttgtatctacattaaatagaacgtcccttgaacacattcgactcgctcgaaggatagagatttcccgtaaaggatatacggttgctattaaagttaggtgataccgtggcagtacatttattcgtacctttcgccatacggaacgtaaccctagcggataccgctacaccctgcacattcatctcgtacataacgtttccttttttgtcagtcttcatctgtacaccggaagttgttccatcaaccgttatacctcctattccgttaggaccggccgccggagtattaaacgctaactgaatggtagccttctcacccttcaccgaaacgaagttcgtgttcggagtaacataaacaaaactaccgcgcttaaactctatacgatccgcttccaatacgaaatccttattcttcaaagcttgcaccgcttgttcaaacaatgcgttagcctcggcttcctccgcagctttcttcgctgccttctctgctttctttgcttctttctcagcctgcttcgcagctttctccgctgacttgtcctgctgtgccatcatcgaccctgcaccaaataataaaacggcgagcaataatacaatcttcttcatattaactcatttttaaaggtttgtctataaaagtacttttatacatacaataaaaatacaattaacatcgacataagttcatctttaacccttatttttcacgtttttaacatgataccataaaaagccccatgcggttaccgccgcaatgaaatcggagaaaggttgcgctagccaaacgccatccaatccccagatcggaggaaatagcaggatagccggtatcaggaataaaacctgccgacttagactcagaaacatcgctttccatgcgacaccgatactttgaaaaaactggctgatcgtaatctgggaaccgacaacgaaaaagaccagcatcgtcagacgtaatccattgtccgtaatcgacaccaattcggcatccgtcgagaatacgctaacgatcagtctagggaataataaactgacgatacatcctacccctgtaatcaaggtcgatactataatagacaaccgcaaggtagccaatacccggtcatgatgcccagcgccatgattaaacccgacaatcggttgcatcccttgggcgataccgataatcaacataaccagcagcatggcgatactggaaataataccgctggcaccaatcgccaaatcgcctccattctctttcaacgcatggttcatgatcaccacaaccacactgcccgccagctgcatggaaaatggagacatgccgatcgtaaatatattccaaataatgggacctttcaaccggaaatatttcgtatggaaacgtacaatactatccttgctgataaaatgactcatcacgaaagcggcaccggcggccatggagatcaccgtagcgatagcggcaccctgtatccccatatccagccagaagataaagatcgggtctaggatcacgttcaatacggcaccgatcatcatcgtgaacatcgcctttttcggatatccagaagcacgcatcacggcattaaagctaaagcttaatgtagccagcaaattacccgggatagcgatatataaatagtctttcgcataaggtatcgtctgctcacttcctccgaaccacattaacaaatcatccaagaaaatcatactggggataatcgtcaaggctccgataatgaatgtcaaagtgaaagcgtttcctaatacgttatctgccagatcattcgccttacggcctagatgaatggagacccttgtagcggctcccgcaccgatcaacattccaaatgcctgcataaagagtagtatcgggaaagtcaaagtcaatccggagatagctagcgcacccactccttgtccgataaatatacgatctacgatattataaagagcattaaccatggtcccgataacggcgggaatcgcataatgtaccaacaaacggcctatattctcattttccagccgccatgtaatctcatttgacatatataacttatgatttatgaattatgattgagatcatctccgccacacttcctacgattctcgtgccctcttccgcagggaactgaatacgcaggctatccggagcattacaataaacacttatataatcctcgctaaccgacgagggcttaaagccattccggatcaaggcattcccaacccaataagaagtcataaaatcccccgcaaccccaataagctttgttggagctaccgtattcaatttcccggtattcggatcaaacacgattccttccttactgaagaacgtctcaaacgctcctcccataatcaggtcttccggcgttccgcaagccatcggacgttttttctcttgcagccacaggcaatcccccagctggatcgccaaatcaagatcatgcgtcgatagcagaatcgctttttgttgctctaccgctaaagtatgtaacaagaccatagtctctatccgacttgtcacatctaaaaaggccgtcggctcatccaacaatatgatggggcattgctgtgccagcgctttggcgatcatggctttctgacgctcgccatcactaagttccgacacataattataagccttatgagcgataccggcggcagcaagcgattcctcgataatcctgcgatcttcctgccttaattgtccgaaaaagccggtatagggatgtcttcctaaagagaccaactcgtaaaccgttattccaccggcatttgtcttctctgtcaagacaactcccaccaaccgtgagaaattaccttgtgaataagaattcagcggcttccccattagctcgatttctcctcccagaggaggttgaaaaccacataatgtcctcaataaggtagactttcccgctccatttaatccgagaagacaggtcacttcacccggatatagattcagatccaacgcatcatgcacgcgctttttctgtccgcctttcaatatatacccaatacttaaatcacttgtctttatcacagggatccgttccatagccactaattaaaatattgaatatttttccggttcacgattacgtaaataataacaggcgccccaagcataggggtaacggcattcaatggcaggatcgtattactgcccggtaccaccatcagcatattacatagaagagcaacgcaggaacctgtcagcattgtaactggcaccaacatcttatgattggaagagcctaacatcaaccgggcgatatgtggaactgctaatccgacaaaggaaatggggccgcaaaaagcagtagttgtagccgttaatattcccgtacacaaaagaatcacgatccgtgttcgtttgatctggatacctaaattagcagcatacatttctcccaataataaggcattcaaaggcttgatcagcaagattgctaataacagcccgattaacgcacaagttccaaagaatggtaattgttccaaggatacaccggaaaaattaccaagcccccacatcacgaacgcatgtacccggtctgtagatgaataataattcaagatagaaataaccgaagaagctagatagccaatcatgattccgataatcagaagcatgacattattcttcacttttgccgaaaaatagataatcagtcccagtatcacgcaagcccccacaaaggccgcgaggattaccgccatatatccgctgatcggccaatccgtgaactgccccaacgtaccaccgaaatagagcatgatagcggctactccaagattagcgccatcactaatgcccaatatggaaggtcccgccaacggattccggaacaatgtctgtaatagcaacccgctggtagccaaggaagcccccgccaataatgcggttatagcctgaggcaaacgagattgcaacacaatattctgccatgcgatcttatcagatcccttccccagcaaaatatccatcacgtgatccaaaggaatcggtacggccccatacgccagccccccaacaaaaagccccaaaagaaccacccctaataacggataaaaaagtagcgcttgtttgttcatggcgcaaaggtatacaaaaaagcggagttatacagtgaatggtaaatcaataaaaaggccatcccttacagtaagagatggcctaaattattcttagttatccgattcttttattttgagaatgccgcataacccggattctgttttaagttcggattcacctgccaagcatcctgcgatacaggtaacaacttcaagtagtcatcagctttacgctcacaattagattgcggccacattcctgtagtgaaacatccgaaacggatatcatcctgacgggaataaacctcccacgctaattccaaacgacgttccaattgtacttccttcaaagttacagtcgcataattatggtcgctattgccatatcctctctcacgaatcgtattcaccaaagcggtagcttcactaacacttccccctccgcgtaacaaagcttcagctttcattaaatagatatccgccaaacggaaaatatggaaatcatttcccatagaacttgtcaaatccgaagcgaactcccacttgaagcaacgagctccatcatgctgttccacggcactccaattggttccatcatattccatgcccggaatcatgttcacatcgatcgtatggttcaattcgttgttatgatcggtcataatcggcttgcctgttgatttgtctatcatcaagccagtcaagaacgtaccgtccaagcgagcgtcttcctcatcgaacaaacgtacatactccggttgagcgcaaataccattccaagtaccactagcggtaatacccaaagacagataatctttataatgcaacgtattattgtgcaactcattcttcacgtttccatcattacccgtatcactgctagagaacgtagcggccaagatagcctcctttgaattctcatttgtcacggagaagttgtctttccaattaggctctaagatatatcccatagccatcaccttatcacagttatcgataactttctgataagcgttaccggagaacgtaaccccccaagcctcagcgttcagatacagttttgccaacaatgaataagcggcaccctgcgtaaatgaaccataattctcagttgtagccggaggacagatatccttgatttcctctacttcctgaatcaaccaatcaaatacttcctgacgggaagaattccccgggaatactttatccgtagggtggaactccgtcagcaaaggaatatttccccaataatccatcatcacatagatccagaaagcacggacaccacgcaagtctgccacgtcttgagccttctcctcttcggtaaggatctctgagttctgcaatttacggatagcctcgttacaagtaccaatcgcttctgtggccgctttccatgcgcttttaactcttgaggtctgagaggtccatgtatgcatatagatttcccggtattgaccaccatcataccagtcaccacctcgacgagtcggagtcacagccatagaaccggagcattcggacaaatgcatatactctgtccaaaacttcttcatcgtattatgtgagttaccgatcaaagcattcaactcggccgttgactggccaaaatcatcagcgggcaacttgtcatatactgtttcatccaagtccatacaggaagaaagtcctcctaataaaaacaatccagttataaatgataatatagttttccgtttcataataagcttatctttttaattagaatgttaagttaacaccaaatgtaaatgaacgtgccttcggcatgtagttacgaggttcaatacccggagacaaacctgcgttgtcatcgctagcctcaccacggaaattctcaacttctggatccaatcctttataacctgtaatcacgaatagattctgaccggctacatataagcgagccttatccaaccaatcgattttcttcgtattgaatgtataaccaatcgataagttatccaatcgcaagaatgaagcgttttctacataataagaacatacacgagagttttcacttaatgtcaacagattatcgttatccattacattcgttccatcgatatatgtattattaccgtaagctgccaatgggttgttcaataccttattgccaattgttccacggaagaagaaacttgcgtcccagtttttccagttgaatgtgttattccaaccatatgtcaaatcaggttgagcgtcaccaacatacgtacggtcatcatccgtgatctgtccgtcaccatttatatcctcaatgataaatttaccattctcatcaaggccattacatttcagcatgaagaactgtccgaccgggcgaccttcctcaactacgtgtgaagtcacacctgaagcaccgcgaatccaaggatcacccacgtaaacacgtcccgtagagaacaattcattagacagttttgtgatctcattcttgttatgagcaagattgagagaggttgtccacgtaaagtccttattacggatcacgtctaagttcaataagatctcaacacctgtattcttcatatcacctacattcgcttgaatctgattgtatacgtaagtaggagtagaaacctcatagttgtaaagcatatctttcgtacgcttgtcgtaccattcgatcgtaccgctcaaacgactattgaacaaggtgaagtccaaaccgatatttaacatagcagtctgctcccatttcaagttcgggttcgcgttctgtgaaggacggaaagctgtcggccaagatccgttgttataataagtaccagaagctgaatacaaatccaatgacttataaggtctcaaaccatcttggttaccggtaattccgtaacctgcacgtaatttcaaatcattgatccacttcgtatctttcatgaaagactcttggctgataccccaagcagcggaaactgaagggaaagtaccccacttatggttagcaccgaatttggaagaaccatctcggcgaaccgtagccgtaatcatataccgctctttaaagctataatgcgcacgagcgaacaaagagatcagtttatattcattccggctggaagtaacattaccgatcttcagcaagtttccggattggatattatcagcgcccatcgatcctacggcgaaattcgtagcctccgatttctggtcggcgtacaagttattttcccaagaataaccaacgatagcatcgaccttatgctcctctgccgagccaaaagctttcgtataattagcggtccactctaacaagttacgatcccatagtctattacgacggattgccttacccgtatcaccctgtccacgagagttccgaggatcttgccattcgctatagtcagatgagaaacggctcttatacaggttcaccttggttgtcagtccatccaaaatagagaactgtacatcaccttgtccatagaagtagttattagctgctttcttatagttctgatcttggttctgaaccgggttaccttgatcataattgtggttggcatccgtgaaataagagccgtccgcattataaaccggataaaccggaagcatattgtaagccaagatatagtcatcagaaaacggcatctgcatatccgtcagcgttgcggcacccgttaatccaatacgtaaacggtcgttgatagcacgttgctggaactggaaacggaagctatgacgagtcatgtagttatcgcgagccacaccgttacgatccaagaaagtataagaagcacgataattactcttagaagaaccacccgacaaagaaagagcgtgttgttgagaaacacctacacgagtcatctcatcgaaccaatccgtgtccgagttgtacttatcataagtagagatatctttacccaacgccttattagcggcacgccactcagaagcgttcaacatgtcgggcttgttcgcaatggtagaggcggtaagataaccatcataattgatctgggttctggaaccggaacctctcttcgttgtgatcaagattacaccaccagcggcacgagaaccgtaaatagcggcagaagaagcatctttcaatacagagattgactcaatatccgaaggtgatacagtagacatatcaccacccggaacaccatcgatcacgatcatcgggccttggtcgttctgcaaggtagaagtaccacgtaattgaatctgggaactacgagttacatcaccggaaccagacgtaatagtcagacccgctaccttaccttgcagcaagtcggacgcgtcacgattcactcctttattaaaattttcctcggaaatgttcgctacggaaccggtaatctccctacgagtctgcgtaccataaccgatagctacaacctctcccagattcacgacagaggcaccaagcttaacatctacggcagagcgccctttcacagcttcctctaccgagttgtaaccgataaaagacacttggagaattgcttttttcaggtcattcacactaagggtgtagttaccgtcaatatcagtgatggtaccgttggtagtacctttttccacgatattcgccccgataataggctcacctagttcgtccagaacttttcctttaacagcgcctgactgggcaaaagcggctgtcatgcaaaaagacattaacacggaaagtatggctacattccagtgtttgaaagaatcaaagattttctttcgttgcataattacttaatttttaggttaacgatcatttaattcacaaatacaattgagaatttccatggcaaatgtaacttaattttttaaaataaactatgattatgtaaaaaagtaaggaaaatcaaacaggaggtctttcggtagatcaaaataaatgtcaacggataaacctaaagagtgacgttttcatttcgataagccacttatagtgacacatccttttccccgacaggctcatctacaaacataaataaggagaaaatcgtttctttagtggttttaaggtagaaaaagagtacttttccctcgattacaaccctgttgtaagatacttacagtagtattataaggtacttacggtagtgttgtagcatacttccgactgtgattcgcatcacttccgaatgaaaaaccaatcacttccgaataaaaaagcctccttttacttgttaagcaagaaatagaggctctctttttcgctggaagaaaagggagggaaacgatatacatctacaagacaaggtgttgccattattttcattcaatttcggaagccttacgcccataagcccggaaaaatcgattcttcgggactttaaaatacaaaatgtcaatttgtcaatctccctttatccttgtctatagttctggacggactacgctaaaatctatctctccatcctctccttctcctttatcaacccattccgataggcgtaaagaagtttctccaagtccttgatctggctttgaagatccgcacccttatccgtatctttcaccatctggcgatgggagcttaattctaccacgatcgtggtggatttgatatccaagccttcctcgatcgctttcgcccgggattcgaagggttcgtgttgcacaagctggaaaccacgggagtgatatactaatgtatagcccgcgataccggtttccaaatgatacggacgggagaaaccgccatcgattaccaacatcttgccattcgccttaatgggattctcaccttgattggaacggacagggacatgtccgttgatgatatgccgatgcataccggtcaccccaaactcatccaatatcttatcacaaatttcctcttgctctcgtaacgtataataagcgcctttttcctccttatgagtctcggcctcttcgataaaggcacgctcgaaagtagccatcttgcttttatcgaataacggggagtccttgccgccccaaagataccagatataatcatgcgcatattccacttcttcctgttccccggtcttgaaataagccgtacggatcagttggtctacacggtccaacaaagcacggcccttataatcctgccccaagatacgtactgacttaaatgtaccatccggattcatcgggatagaggcatgaaacagtaaattggaattacaaacctgatacattcccccatgccggaagaaacaacgcatatgctttttcatcttctcgctgctctcaaaagaatgcaatatctttcggatcaaatcctcttcctcaatagaaagacgatacggatctttcgggtctaaagtaggccagttagtatctttaagcgtataatcctttccatcgatatgaaccactccccgcttcagatcgatatggtgcaacaacatccggtcatccatctcaaactccggacgacggcggatgatctcaccctccagcttgaactggatgatggtgatcgccttgtgcatctgggcgatcaaacgggtggtcttctcatccattgcattatcggcgaactttgttttcggcatgaataacgcgcaaggatcatccccatacgcctccatcgcgaaagtggccaacggcaaaagattgataccatatccatcttctaaggtagccatattaccaaagcgtaaacacatacgaatcacgttggcgatacttaccaaattaccggaagcggctcccatccacaagatatcatgattaccccattgaacatcgaaattatggtaatcgcaaaggatatccatgatcagatgagcgcccggaccccgatcgtaaatatcgccgatgatatgtaacaggtcgattgtcaaccgttggatcaagttacacatagcgataatgaaatcgtccgcacgtcccgtggagatgatcgtacaaataatctgatccacataagcggatttattcggctctacggaagactcgtgcaataactcctgaataatataggagaactccttgggtaaagccttacgtactttcgaacgggtgtatttggaggacacgttccggcaaacacgtaccaattgattcaaggtaacttgataccaatcttccagatcttgctcttggctcttgatcagttccagcttatcctccggataataaatcaaggaacaaagctccttcttctcggattcccggagcgtattactgaaaatctcgttcaccttgcgctttacggcaccggaagcgtttctcagcacatggctaaaggcttgatcctcgccatgcaaatcactcaagaagtgctccgtacccttcggtaggttcaagatcgcctccagattaatgatctccgtgctggcatccgcgatcgtcgggaaactccgtgccaacaattgcaaataccgtaaatcgttttgtacagattcggctataatatcttttgtcatcttatctcttatttatacgcgaatataaatagatccggtcatttaaaccgaacctgctccggtttatttttctcggctacttgctggatctcataggggctgacctctacggcacctttcgtcaattccggaatattgtaggaatacaactgatagtcatacttatccggatcttcttgaggcaataagaacggtttcgaaggcttaccgtctttccctatatgacaaatataaggtaaagtatataaaccgttatcccggcggctactaaatacgacccaatcactattactactccaagaatgatagctatctgtatccgggctattcaacgcagacatatccatcgctgtccgattctccaaatccatcatccggatctccgcatccgggtgccaaatagggaactgcccataagcggtttccgtgtacatcaggaaacgtccatcgggagagatacggggaaatgtatagctcaagctatccgcatgtaccaacgtatcgatcgggaagctgatctcgccacgatccggatcaaacgcaacacgacagagattataacgtaccttatcataattctccggcatcttctgggccggggccgtacagaaataaagccatttaccatccggagagaacgcagggaaagtctcgaatgcatcttttgtgatcaatgaggctttcgaaaggatttctttgtttttcacgtcatacaccaccacatcggactccaagtcgaacacttccatctttttctctttcacggaatggaaaaactgtttgatatcatttaccgatgtggtgatatagcgcccggaaggatgccagaaaggatacgtcatattactgatcgtcccattcgttttcgtattcaatttactgattttcttgtcttggacaatataagttcccccattcgccgcacgcatatggaacatcatctgccccgggtctcccatacaaaaagaatggcagttcatacaattatagccagtcatatcgttacggataatcggctgttcgtcaaacgactccaaattccgctgataaatacccacaatatgccatttctcgtatcccggctctatcaaacggtatactaaatgagagtcgatcgcttgatcactgatatagacagagaatggtgcccatttagtccattcgtctccctctttcgtcgtgatcgttacaaaaaaggctttacctttattcgcacgggtaagccgttcccaatccttggacttaaaacagatcgtattcgttccgtaatactcaaacaccccctgctcgctaccctcgatcttcgcatagcatttttcagcgggcacgtcaatacggaaattcaatggggctatattataaggtatagtaaccccttggtaatccgggaacatcggcgggggagacatgcgttcgttctcggcaacaacaaagccacccggatgtaccgcccaaaaacccaagtatagtacaataaccagaacttgcaatagtaaatatccgatcacaaagtttcggacgatctttcgtttcctcgtattatccatcataattattgtcgtttaggagtcggggtaaattgagcgtaataataataggtatcgccaaactgcgctttcaaggcggcaggaggcatgcctcgagccactttcataaattgcagaaagcggttttgtacctccgaactgatcggatagcttttgaacgcctccgggtctttctgcacggcagcgaaaaacaggcatatagcctcctgatagagaacgggaaatgactcgcctcgctctttcatcaattccatataatgcataaatgtcatcaagtctttataaaccaacaagtatcccattccatactcaaaagccggacgattatcggcatgatcgtcgatcaagaaagccagcgcattgggaaatgtcaaggtcaagtctaagggattatccgttaccggaagtaccgcccgcttcgcctttatccaatcggtagaggcacaaaccacggagtcgagcaacgggcgctgcgcttttgcccaatccctgtagtggggagtcgattcaagaatcttaatatatttctcggcggcacggtattcgccggttaccagataagtctccaccaaacgcttcatcaaacgaggctgcatgcaacgttgcgagcttaatacacccacaaaggcgaaacgttgcgctgcgtttacctgccctacttgccaagcaacctcgctcgcctcgatcaatcccatccggcttttcggatcgtgcgggataaagccctccaccccgatctgagggaaacgcatcaaatcgccagaaaatcgtcccgtatgtgataaagccagattcaaataaatcagggcatccatatcccggaccgaatgcgcacgagcatgtgagactatctcttgccattctccctgccgtgcatagtaatcgtaccgataggcctgctccatcgggtctttcttatagagaatcccataagtcatcgctatcagaaggaaagcgtaagaaacgattcgcttccaagattccttacggataaaaacccggttccttacataataaagaattaaaacgatcaaaggatatgaaagcccgatatatcctaaagaattaggtatcggatattcgggatggcatagatgtttgctgaagaacgcttcccgcatcggaagaatataagccgtacgcatggcgatcaacggtagcaaacctccccaagcgatagcgataatggctactccaaaacgagccttatcctctttagcacaacactcataaaccgcgatcaataaggccaataataaattagcgggtgccgcaaaaaaataagagccccccaaaaacaagaagccaaagagataacgaagccaatcaatcttgattgaagtatacaaatacgcaagaacctgcacgaaagcgagcatcgtcaacaaggcgattgactccagcggatagatccaaattaaaaaagagggaagaatagccgccaacatagaggcacgcaccccacaagcttttaagtaaaggaaaaaacagccggagatcagtcctaataataaagcgatcactaccgaagctccataaggatggataaacgcgagcgataagaactcagtcacatattcattcaatccacccggttcggccaatcggtcttggaaataactaccggtagtctgaaacatcatatactgctccagaaaacgataccaataccgaaaattcaactctatgaataggatacttcctataataaaaaggaatagtataatagtattattgttaacaaatagtctattcttcattctccaactgtttttcggatcgtaaagatagaaagtatatagaagatggcaaaagaaaaggtttaattattatattgaacacggaacacacggagcgtgtgctccatgttcaaagctatatttcttacatctgttgctcgccgccgccggaaccgccgctcttcatatcatcgttgctgatacctctttttactttcttgatggcatctttcaaggtgccaaaacgataagatacactaaccattaacattctcatcgtacggtaattgatctcacgacggaagaaggtatcatcggaagtagtattttccatcttcattcgcttccagaaggggttttggaaagacaactggacagatagctttttcttcaagaaatccttgttcacggagattcccgtgaaatagaatggagagcctttcccctgtaactggatccaaggagagaaatatcctccctgtatgttcacacggaaatccaacgggaaattaaactgcgtaccggcgaatatacgaccgctgaatccactattcgccatatcattcttttcgctcttcaaatccgtataatccattccaccattcatatagatacggaacaaaggaaccggattccaatttgcgtatacgaataagccggtagattgtttctttccgatattaccgtaggtggtttggaaaacacccggattctccggatcgataaaggtatattgctcgatcgaattattgacgaacgtataagtagcgctcgcgttaatgctgaatttctgggcgaacatactatagttcaagtttatattattacttttctccgagtccagattcgggttaccgaaggatatgttctgtgggtccgcattgtttacataaggattcaaataccagatacccggacgctggatacgcatattatatcccaagcgaagctgttgcgccatactcaattgataagagaccgtagcgtttggcaccacgtcgaaataatgggtatcaaagttcatatcgggagccatctcatatttcacgtccaaagcggttccttccgcacgtacccccgccttcacgccaaacttatcaaacttcatcgaatagcccagataagcggaatagatatgttgggtatgacggaaatggctatctttagaagttatgtcctcccatatattcaacgaatcgttgaaagcggtacgatccgtattactccggctctggcggaatatatattttgcgccaacctccaaggtctgatccttccacgtaggggtcgtataatccacctgcccggtgtgctcgttcgtagaagccttgttgatattattttgcggatagccgagccaaggattgtaattcacgacattctttaattccgtataatccttgttatcattgggagaatggctgaaacggtaggagatcgtcagcaactcatcttttttatgggtagagtgttggtaatccacgctcacgtccgtagaaccaaacgtttccgtagcgtccgaattacgattataatcgtataccggattacgattgatatcctgcatattcaccgtgtattccgaacggttcgtcatcttaccatggaataagttcgcccctacggtcagcaagttcaaggagtcgatctcataactaccttccagcgaaccaaactggaagggtccgttattcttcctacgtccattttgcgtcaagaaatgttgctcgtcattttccaaatcctcacgtatcgaggtagactcattccaaggctccctattataattgtaattataattcgctgtcaacccgaacttacctgctttaagggatatatagccgccaccgcctacacgccccaacgaactaccgttcacacgaaccgtaccagtatatccttgtagagcgtttttcgtcgtaatgatattaataataccaccgataccctcagcgtcatatttagcgcccgggtctgtgatcacctctatgtttttcacggaattggccggcatactcttcaatacctcagctggattgttactcaacaggttagaaggcttgccattcatgtagatcttaaagttcgtggagcctttcaattggatttggtcatctccgtccacggttaccatcggtaccttgcgcagcatttccaatgtattgtttgtctgtgcctccggatcatcttccaagctataggtaagtttatcgatctcagccttcaccaaaggtttctgtgccgtaaccgtcacttcccccagccgctggttatcctcctgcatatacaacttacccaaatccaagttcctctgtttatccgagatcgtaaatgttttctcggcaggagcttttcctatcgattgcatagagatgatgtatttaccggcgctactcaatggtgcctgaaacttaccatccacatcacacgctaaaagcttgaccggcttatcgggggtcttcgctaaagcaattctcaacgtcgcatagggtacggactcgttactcagcgagtctaacacctgtcccttaattgaataggaacctgtcttgtccgcttgcgcatacagaggaagcgcaaagaacagtacccaaaataaggcaaacaatttctctttcatacgttcatctatcactataaaaataatacattttactgcaaattacactatttacgatttcatcgtacaaataaagtcattaataatgttcatatttcctttttcttctaaagaagtctgaaaaaagagtattttttcataatagacggacatcaagtaaaacaggttgcacaataatcctaggaatctttgagaaaacgaatatattgttatttttgcattcgtaattctttaaaatacaatgtcatgagaactatcttttgtgtattagccactttgatgttgggtttgacgagtctgcaagcccagagtttaaaagccattaagttgaatgctcccgacaagacccggggcgcttcggtaatgaaagccttggcagaccgtcactccgagcgcgagtttgccaacaagaaactcagcctacaagatctttccgatttgatgtgggccgctatcggtatcaaccgggaggatgggaaacgtaccgccgcttctgccttgaataagcaagatgtggatgtctacgtattgatggaagagggcgcttatctgtatgatccgaaagcccatcaactgaacccggtagcggaaggcgatcaccgtccactgattggaggaaagcaaacctccgtgaactcagctcccgcttgtctattgatggtttctgatgtttccaaattcggcaatgtaggtacaccacaattacgtgagcgctttggagccttagatgccgggctggtctctcagaatatcgccttgttctgctccggatgtggcttggtaacggttccccgcggcagcatggaggctgatgctttgaaaaaagtgttgaagctatccgactcccaaatcccgatgatcaatcatccggtaggatacgcaaaataacgtcagcactcacgtaagcccccgagaatcatcttgtgggcttacaagaccgctcacgcaggaggctgagaacaatctttacaaaaaatagatattccgactctccgaatatgatcaaccaattccatattcgtcaatttatgaaaaatagagagatcaaactgataaggtaataataaatcatcaatcgcaaacgcaatctgatttaaccgactacgtgtcaagtttgcccccaccaaagatatatccacgtccgaaaaaggtttatggtttcccttagctcgcgaaccgtaaagtattacttcctcaatatcctcgtatcgagcgtaaaactcacgcaacttattcaattctatgtcactcaatccatatttcatttacagcttcatctagtctcattttccgatatacataacatcctctcttcaaaccggcaaaatagtggataataaaccagtacgatattctcataaatttcagaagccacatcgtcatcataattatgagaagtcaaattacgatcctcaattgtctccatccatcgtttatcttctataagccctatttgtaaagccttacgtatagcatcacgtgaacctcgaatatccgtataaccttgatattccgcataatctttcatcaccttccagactaattcacgggtatattcaaaacgctggattaatccttcttgcaaaagttcatcaatctcgtccgctaattccaaccgccaagatacaatgtccaccgcttgacccaatttagccaaagccttacaataattagaaaatcgctgtaaccaacgtatatcttgtgccatatatgtaaactttagaatacgaagataagaaaaacagaagatattcctacattcatttcttgaaaaatgcaaaccaagcaatcaaagccagcagcacgaatataaccaccaagatcgtattcccccaacgaatcaggaaggaaggcatctcgccaatcatgttgcggactttctcgctacgcaactcgatacggttttgatccgattctgcttttttcttcatctcattgtatgtcgacatatctttaattccccaactctaattgattcttcactaaattataataagcgcctttgcgatcgatcagcacgtcgtgggtgcctacctctacgatacggcctttatcaagaacgactatttgatcggcattgcgtacggtacttaatcgatgggcgacgattattaccgtcttaccccggtaaaagtccgtcagattctccactatggcacgttcattgttggcatccaacgaattcgtcgcctcatcgaaaaagagataagaagggtccttataaaccgcccgggcgatcaagatccgttgacgctggccttggcttacgccttgaccatccggacctatcaccgtattatattttaagggtaagcgctcgataaattcctctatattggcgatacgagctgccaataataagcgagatttatcaatctcaccgtcatccacggcaatattgcgtgcgatcgattcagagaacagataaccgtcttgcatcaccgcaccacattggtcacgccaccataaaaggctgaaagatcgcaaatcatttccacccacccggatatcaccttctaccggattatagtagcccaataataacttgatcaaggttgttttcccgctaccactcgttcctacgatcgccgtaatcttgcctcgaggtattttaaggtttatccgctccaagactttcggcgaatggatgccctcatattgaaacgtcacgttacgaatctcaatgtccctatcgcttccgttaaaaccggttatcatacgttccggcgtctcctcttctttccgatcatggatctcgctcatccgttccagactaatcttcacgtcttgccaactataaagaaactgcacgaactgttccaccggagcgttcaactgcccgataatatactgtatagccaacatcatacccaacgacaggctacccccgatcacagccgtagcggcaatcaccgtaatcacgatattctttacctcattaatcaagatactgccggcctcctgactctgttgcagccgcatcgattcgatgttcgtccggaacaagtccgcttgtatatcctcccattcccaacggcggcggcgctcacaatgctggagcttgatctcttgcataccattcaataactgcatggttttcgattgattacgggcccgttgctcaaaataagtatagtccagcaaacggcgttttttaaggaagaatgtcacccatacggcatataaagcgctacctagtacgaaaataaagaatatcaatcgattataataaagtaataccccaccgaacaccacaaagctgaaagcggagaaaagcaccgtcaatgtctgcgccgtcaagaaacgttccacacgctcatgatcatggatgcgttgcaagagatcgcccgtcatcttcgtatcgaaaaacgacatgggtaatcgcatcagtttgatcaagaaatcggataacaatgatatattcaccctcgcacttatatgcagtaatatccagcgacggataaagtccaccgaggcacggctcaagaccagcatcaattgtcccgccaagatcagatagatcagattcagattcttagtagcgatacctttatccacgatcgcttgggtaagaaacggaaagattaattgcaatacgcttcccagcgcaagccccagcaacaactggataaagaaacgtttataaggtttcatatacccccaaaggaaatgaaagggatctcttcccgtatggcgttcatctttccgcttataaaaagcgggggtcggctgcaaggccattaatatgcctttctcctcccctctcgaacgggtactgatccacgcattacgaaactcttcctcatcgatacgcaacaaattcttaccgggatcggctatataaaaaacagatttcccatcctgtttctttttaacgtcatataatacgacaaaatgatcttggttccaatggaggatacaagggaaggggcgttgctccaccatcttccccaaggtcattcgtccacatatcgtacgaaatcctatatactcggcggcatcagcgatacccagcatggagactccttcccgggttacgacgcaaaggttttgcatcgtctcggcggaatactccttgccatggaacttggcgatcatgcggaggcaggtggcgccgcattccatggagtcgggttgcttgatatgggggaagctcataatttaataccttcctctatactatacacatttttccgttctttcattgctttcgacttgtttttacggaatgtataacgaagcaagatccaaggccgaaaagaggcactgatttttcgttgatcgctgtagttctcatagctaccactacgtaattccatcgaggtacgataagtaaccaaacaattctccatcgccacggaaatatagaaatagtccgtaaaattataagagacctgtaccatcgaaaaagaagggctatgatacttcacacgagagattggcgtataggtataattgttatataatatatcagcacccaaataccacttcttataattcgcattgaaatacaaataggtactaaaccctttccttggatcttcattctcataataatccacgacatgatacgcattgacacctatacgccctaaattgcctatccgataagacagacttccccctatgcgtaaattcttatacttcccgctattcctatagctactgatataaatatcctcttcgctgaatccatacgattccaccaagtccgtactgatccgataagagacgctcggtgtcaaataaaatcctttcgtgttaaatgtcaaggataggttcaatttatgattttggctcggaagcagataaggatttccttgtgtcttcactaaagaatccgtagacatattataaggattcaattcgctctcggtaggagccgtattggtaagcgtgtatcccaatctcgtagatagatgatcgctaaaatcataattaccgcttaaagaaatgcgaggcttgaagtaatgattagaggcctcacccgctttcagccaaattccttccagcccagcagaaagcatataagaaaaacgctttatagactggctatagtccgcatacaaatactcttcccatttctcgtgccggaaagtaggcattcctatactcacttgacgtatacgatcactcgtaaaacgagtctgattccctacattcaagctacctccatttgcaaaatccacattataatccacatcaaaacgaccggaattccggtcgttcttatataaatatgtattcagataagaccaatccagatatgactccgagcgatttccgtcattctcgttatgattcttattgaaagcaagggtcgtttccaatatatggtttttcgcaaacgtatgcttatggaacaagctagccgtaaaaatatacgattgatccttattaaaagaagaataatcgaattcttggggtattccatccgttaaaagtccatcaccccaacctttcttcttattgatttttttattaccatacatatgagctacgatataatccttgtctgtacacatccaacggaattgcaactcacctaaatagctagtaccatccaaacgttcctctcccttcgtccatttactataccccgtatttagctgccgttgctcctgttccgagcgatcatcatacaaatagtccactgaagctcttccataaagtgcgtatcgagagtttccaacctcaaaataccctaccccaagccccttacggaaagggacatcatgccgcgtggctccttccaagaagataaaaggttgtgtcttctttttcaattttatattcaatatcttttggtaaccatcctttaagtaacgggctttcaccacatcgattatctccacggattctatctctctcggatcaagagtggcgattcccgagttataacgattcccgtttatcaatatcaagggttgcgccccatcctccaactgcaccttccggttagccacatccgagtacaagcgtgggatctcttgcagggcccggaaagggtctttcatatttttagccttctctgacagataaaagatctctcccgtagcggtccgattcacttgatcattccgattacccgtcaccattacttcgtccaatacgaccgttttctcaggtgtcagcaagaagtcttttctaacatccctgttttccactcgcaatatttgctcctgcgcattataccccaagaaaaacaaacgtagctcatacgctccctccttcaatccatctatacgaaaatgacctttttcatcagttaaagccatggccgataacgagtcttccacactcaatatcacctgtaccccatccatcatcttccgcttctcgtttgtaattattcctgagaaggtgtaagactgggcagacaatgtgaagaggccttgtgagatgaacagaagccagaaagcgatagttctcatggtattatgcgtataattcttcttttaataattgacatttgaaaagatacatcagatattctttcaaagtcatattgattgcgtcaaatgtacatatattttcccccggatgcaacattatttgtttattacatggtcccaaacaggcaggcagtaatttacaatctatacaattttgaggcaatatctcctttaaccaataagaaagttttgtctcattccaatgtacctgtcctgattgtaaatcaaattctcctaacgcattttgatcatcaaaagaagaaatcgtagaacacttaaaaactttaccatcataattaaacaaaacttctctatgccgttcagcaaagcaaacatctccttttggcataatataataatccaataaaaatttcttatctaaaaacttttgaaccgaagcatgtaataacggcacattaactttatctttttctagttgccacacttttttcaaaatgacaaaacaatacttacgatctagaaaatccaaatcaccaatgatttcatctattttctctaatgtcttattatcaaagtttattcttaccgcaagccacctattgggaattttatcattaataagccgaatagttctcaatgtcttctcataagtatcctgattcgggttatccttatctttctttatttgattatgatgtattctatcaccatccaaagtaatttggaattggcattcaaagttttttaaataatctataatagattctgttatcaaaatcgcatttgttgtaaattcagcaattagatccaattgattaacttggcaaaagtttctcgcaaaatccagaatttcttttatccctctgaaatacaaaaaaggttctcccccaaagaatgataattttaatatcctataagatgttttaatatattcttgttctatattcttttttatagcttctattacttcactcttcaagaaacttcccgctattctattctcgtaacagtaccaacagtttaaattgcaatccaatgttgtattcaccatgacttgatacatagaggcatcaaattgcatcctttttttccgaaacaagacaatctctctttcatcaaaatcatcaggaacaatatattgattatccaccaaagatttatataatacaggatcagattgctctaattttaaaatattttcttttttatatttttcatatctcacattatttaataatataaatttattattaaatgaattataaagtaaataaacctgcggcaaaacgttctctacaacctgataatatatcttcttcatttcatttttcattaatttctcgatagaaatagctgatgccttctccctgttacagggaaagcatcaaactaaaaaaactatcaattagccacacctccctgaagaattattgactcctccacacttacctgagccattgttagtaccagaacaacttccatccccattattcggagccttatcatctggatcctctcctccacgaactaaaataagttcattttcctctagcctctctaaaataaggctaggcaaattcattaaatcattcataatatctaaaatttatagtttataataggtcataatctatgaccgtttcatttactattttacttatgactgtctaggattttcttgtggacacagaaccttccgtccatcctcaatccaataccattcgtcagtctcttcatcataatgccattcaccaccttttatagcggaaagttcttccttcgacaacaaatcaccaatttccatgtctatatgcttttttagtctgttacaaaaatataagtaaaatttcgtactctatctaacaaacacctaattttcatctaacaaaaagctaacaaaacgagaaaaacgcatcttttttaagattattcactatcttcacatccaaaataacgaatctatcatgaaacactccttatatattgcggccattatgttgctagtcttaatactctcccaaggatattggctatacaatatatataacgctgaaaaatataaaacgcaagaagtccttgaagagctattcgaagaggctatcaagcaagaaatgtccaagcgaatggttagcaacaaaccgaaagaccccaacaaccccaaaagaatcataagaagagctagtgatatgacaccagaggaacgagccaagctaaaaggggataccataatctggccacaaataaaaaatcggaatctaaaagataactatgccgacctattagcgcaacgtatgcaagacggtctacgtaatgcaaatagacccttaaaaccaaatgtattagacagcctattcaataaaacattaactgatcacaatttacaagcaatatcttatatagaaatatcagactctacccggcaaaccgtaaatacggtaggaaaaaaattcaacctttcattttataagttccaaacagaaaagctcccgataggaacgcagggattacaatatgtacaggctttcgttaaattacctctttctgacattgtccaacgaaagctcttggcttttatcgtatcttgtctaatcatccttacctcggcgagttgcctatattatttattaagaacaatacgtaaagcccacgcccaactccgagaccgtgaaatagccgtacatagcgctatccacgacttgaaatccccgctgaacacggcgtatgcctctatggatcttatcgctagcctagagaatgaaccgatgaaagtgaatatattaaataccggaaaaactcagataaaacagttgatagagatcatcgagtccatgctgtcactattgaaaacagcggatggaaaagagagcgcacgaaagtcgcctatagatattaaatcatttattgagcaaacctaccaagcgatagcaaggctctatcctaacaagatccccttgttcaagcttgagaaaagcgaggatttccccgacatgatcgaagctgataccgttcgtctggaacgttgcctccggaatttgctagagaacgcattgaaatattcggatgacgatgtacgaatcaccgtaacgttgactatgaaaaacaaccattaccgaatagccataaaagacaccggttggggaatccccaagaaagcccagaagaaactcggacaacaattcttccgggtgaaacaagccgacaagccagcgcaaccgggatatggattaggtttgagtagcgtaatgctaatggctaaagaaatgggcggctccctaacttttcagagtgaggagggtgtcggttcaacatttttcattaacttaccagccgaaaactcataacactatatggaagataaacagaaagtgatctttattgaagatgacccaaaccttggattaatcatcgtattggccttgcaaagtaaaggatacgaggtttgctacgccaacacgttaagcggtattcaagacatgatagaaaaagactgccctaatatcctgcttctcgatctggaagttggcaatcaaaacgcattggattatttgccttttattcgttcaaagcatccttcattgcctgtactgatagcctcttcccacaacgaaggggaggaaataacacgctgctatgaagccggagctaatcattacaccaaaaaaccgtatgatatacaagaaatagatttcctaatccaaaggttttgtaaaaagggcagtccgatatcaaatagtatatctattggagattaccaactggaactctccactcataaattattctataaacaagaacagtcaaaaacattaagtcctaaagatttcaagttattctatctgttatccgagcaattaaatcagccagtaagcagagaaaagctttttcatgaaatatgggatgggcaagaagttcatgatagcctaaacaacagcatctcgcgtttgcgcaaattattggaaaaagataccacactttcaatagatgccgtaaaaggagttggatatatattatcaaaaaaagaccaactctcctcatcgtaattaaggggggcttattgtagatttctagatacgcccttgttccctatcgcatgattcgggaaaaacacgtacgacttttttgaaaaacacctacgacttttccctaaaacacgtacatgttttgagtaaaagatcatcctgttttaacatactaataatcagtatattatataattcttttcattaccaaacttattgtttggaatttatatcgatcctatagggacgtagcgtgcagcgtttgctacctaaagagttttcattatcttcgcagaaaattaattgagatgtggacgttctttatcatacttccaatcctgtatcttgcagggaatatttatatttatctaaagggaaaacaggctttgaaaagccagtctaccggagttaaagtattgttatccattgttttttggggaggagctttatcattcttcagtagttttctattcaggaacctagatatgccggcttctttcgctcaaacagtttcccaagtaggaacaggatggctcgtgttcactttatacatggtattagctctgttggtatttgatatcttacgacttttccacctacgtttcaaatactcattctatttatccttattcttaacactcagcttattaggatatggaaactataattaccaacatcctgatacacgagttatcaacatggttatcaacaaaccggccgataccgatggacagtcgctgaaggtcgtagccattagcgacatacacttaggatacgctaccaacaagacgatgcttgccggatatgtggatatgataaacgcccaacgcccggacatcgttcttatcggtggagacttgatagacaacagtgtcgcacctctgcgatacgagcatatggaagaggaactgtccaagatatacgctccattaggcgtttatatggtaccgggtaaccatgagtatatcagtggcatagaggagagcgagaaattcatagcgcagacgcccatcgtacttttaagggattccgtggctatcttgcccaatcagatccaactcataggacgggacgaccggcataacaaaggacggaaaactttaggtcagcttaccgcgaaccttgataaaagcaaacctgttatcttactagaccatcaaccctacgatttagagaaaacggaagaggctggcgtagacttacaatttagcggacatacacatcgaggacaagtatggccgatgaactggatcgtggatcatctgttcgaattaagttacgggattaaaaaaatcggaaatagtacggtttatgtctcatccggcttatctttgtggggaccgcctttccgtatcgggacggacagcgaaatggtggtgttcaatattacattcaaagagtaaagatgaaagtatttattcaatcgatcgtagcgcagctattactaaatccgtatattttctggagaggatatcaagcgcttcctcctaagaaaagttgccggattccttttatcttgtttttcgtactcgaactatcgctttattttttcggatttattttcaggaatgaactacctgataacgtgataatcacgatccaatacatctgtaacacttggtatatagcgtccatttatatcactttatctctcttggtacttgagttgatcaggctctcccaacgtatcaagccatggttccccaaatggatgaaagggcattggcaacaaaccaagctaaccctgttttttcttatcgtattcggtgttaccggtttaatgattcacgcataccatacggtaatgaatccgattgttaagaacgtatatatcacgttgcccaaagccgcaggggatcgggatagcctgactattgtcatgatgagcgacttacatatcggagaggttatcgggaaggacttggtacaaaaatatgtggcactcagcaacgcacagcatccggatatggtggtattagcgggggatatcatggattatgaatcccgattcgcggaaaacgcccacatcgaggatgatttaaaacaattaaaagctccgttgggcgtatatatcgtttacgggaatcatgaataccgggcaaaccggaacgccaaatatcgttggctgcaaaagaccggaggtacgctactaatagactcggtggtccaaccggactcaactttttatttgatagggagggatgatttcatccataagaaacgaaaatcgcttcattcgttaatggaaggggtggataccggcaaaccgattatcgttttggatcatcaaccttggtcgttcgccgagatgaatatgaatggggtggatttgggactgcacggacatacgcataacggacagttatggccttatcccctgctgatgaaacttgtgtatgaatgcccgtacggatattataagaaaggacctacgcaattctatgtatcttccggcattggtatagcaggacctccttatcgggtgggaaccgtctcggaattggtcgtattgcatatccgcttcaaagcccccaaacagactggcgaaagagggaaaagcacgatgcccattcaagggagctgacaatgggcatcgtaagctcctttgaatgggcatcggcagaaacccgcctattcggtacccttagtggccgcttccaactcaaccggcacgctcaatgtacgcctgtataaatccggatcgcccaatacctccaacgctttctccaatacaagatcatctttcaagctttcttgcaactctcctcgttggtaataataacgttttacgatctcggcagccattactcgtttcacctcatccttgaaacgatcgaaatctttttccagattcggagtcagcttagcctctaattccttgaacgcagtagaatcctcctccagatacccctcgaactcagccacttctttcaagttcttcaatactttctcgctttggcggtcatacgtgaaattcttggacttggcgtattgcttcaaagcttcgaaatcctcatcggaaaccgtaaattcctcgatgggagcgatcgtcttatgcttttgtgcccaatccgtaacgaagtcgaacaagaccgtatccgccgccaaataatacatcatggtaggcactttcggctccttcacctcaaactccggacgtacaccacccccatcacgaaccggacgcttcttggacgtatagaatacggaagtcaagctatccggaatagcagccacgctaccatcctctttccggtgcgaataatcgatttgctggatgcaacggccactcgggatatagtatttactcatcgtgattttcactttcccattataaggcaggtcacgaggagcttgcaccaaccccttaccaaacgaacgttgtcccaccaacacggcacgatccatatcctgcaaagatcccgatacgatctcagcggcggaagccgtacctccattgatcaatatagccaacggcattaccgtatccaaaggctccgtagaggttcggtacgtacgatcccattgcttgatctttcctttcgttgaaagcacctcgctgcctttcggtacgaacatacctacgatttgtacagcaccttccagcacgccgccgccgttaccgcgcaaatccagtaccaaagacttaatattatgatttttctttaaatccaagaatgcctctttcacctcttgagcactcttgatagtaaatgcctttagataaatataaccgatactgtcattcttaaccccgtagtaagtaacttgaggtgtcgtgatctgcttacgggtaatctcgaacttccggggtttcttctcgcccggacgttggatcgtcaaaaccatcttcgtattcggaacacctttcaataactcgctgacccgggagtttgtcgccttggaaacatcgatcgtatcgatcgccaagatcagatcgcccggcttcagacccgctaaatcggccggcattccctcggtaggctcggcaatcatcacgcctccctcgttgttacgctgacggatcaaggaaccgatacctccgtattcgccggtcgtcatcagactcaattcctccgttttttgctcaggatagtattccgtataaggatctaaaccagccaacattgcctcgattccccgctgaacggttttatccacatccactgaatccacgtagaacatctctacttctttcaataaagaattgaaaatgtctaggttcttactcacctcaaagcggttatctttttgcgcccatcccggcactacgctacttgcgacgaacagcaagcaaaataaacctataattcctcttcgttgaaccaatctgcacatacaatatttagttaattaacggcataaatgtaaggaataatacgccgcctaagccaatatcccttttacttttaactttatttgttcccatttatcatacggaatctccgggccaaccacgtcgatcacatagcccgccaacatcgatccgatgcgtgcggattgtaccaaagacgctcctatggattgaccgtataagaatccggcggcgaagttatcaccggcgccagtcgtatcaacaggcttgcccccctcagccgggacagaataaaattgaccatgactaccgatcaaggcaccttcctttcccaaagtgaccaatgagacctctaccaattcagacaaggtatgtacggcctcagcagccttttgcccggtaaaagcctcagcctcactcccattagagaacaaaatatccacatatttaggaatgatatcctccagcattcctttaaaagcattcacgatattgaagttcgacaaatccagcgctactttcaagcccaactttttagccttctccatcgtagaacgaaccaacggctcgtttacgagcaagtaaccttctatataaatacattgatatttacttagcatctcctcggtgatctcatccggggttattgtcggggctgggccaaggaaagtccccatcgtacgttccccatccggagaaatcatcaccgtacagctacctgtaagtccatccgtcttgataaaataggaagtgacacccgctttttccaacgcatcctcataaaatccgccgatcgaatcatccccgatcttaccgataaaaccggaattcgcccctaaagaagacatcgaacgcatcgtgttgcagacagatcctcccggggtttgcgtacgtggcaagccagctaaagttgtacggatagcgatcatttgttccctgttaatcatatccatagctcctttctgtatcccgatttccgataggatatcatcattttcaagcctcaataaaacgtcaaccaaagcgtttcctaaacctattgtattcattttttcgtaatttttttcgcaaagatattgcatatttcgaaaataccccgtacttttgcagtgcaatttcagaaaggggttacggaataacctttgaaagagcgaaaaattcttccttagctcagttggttagagcatctgactgttaatcagagggtccttggttcaagtccaagaggaagagcgaaaagacatcgggaaagactgaaaaacattcttctttagctcagttggttagagcatctgactgttaatcagagggtccttggttcaagtccaagaagaagagcgaaaagagttttcatatagagattaaaaagttaaaaactgattcttccttagctcagttggttagagcatctgactgttaatcagagggtccttggttcaagtccaagaggaagagcaaaaagagagatacctattaataggtatctcttttttcttttgttctttttccgttattcacagggttttcaacagggttattaacaaccctgtaatcctcctaccctctccaagcgattaaaaataagttctttaattcttccgcaaggactccacgacgcatattgggaagatgaacgttatcccgcaaatcagcgggcatgtctttaataagtacatccgactcctgcgaagccttataaataaactccgtatcaaataaaaagcgattcacctgagttgaggccaaaaacgattttccccgctggttaaaacctttcaaacctccttgagcatccgtatgcgttaatcctagaagcgtaaaattcaatatacgggaagcataactcataatctttcttcgagtacttaaatgggtataataagtatgattccgcacggcgataacgacatcatatcccgattccaaccattctaccatccggcagatagaatccgcctcatacggaaaatcataatccgtatataaagtaatggatgaggtggaatgagacaagccagccctaacagcggctccttttcccttattcgtatcataacttacgatcatcgtatcagggagagcctccagaagacgttccaccgcatccttcgtgaatcctcttttcgaagcgtcattcacgacgataaaacgaagtgagcgacctttaagcatctttaccaattccgcatgtttctcgatcatcaaacgttcccagccttcttgtgggttataacaaggcaagataaggtcgatcgcctcctctttacccgggagagtcttcggccgatgaagcggctctgaaaaatccaatgtcaattgctcccatacgatcttaaaccagatcaacacacaaggaagtgctttcaacgcataaggaataacatacgttttccggatataactgggaaatatatctgtaggggaaagagatgtaagaataaaacagaaaacgaatagtaccgtattcaagacaggagtagtcttacgggtaggcgtacctatataccaaaggcagacggctatcatggctcccaaatatccgctattctctgttccggagctaaaaagaaccataaacaaaagagtagagcaaagaaaatgcatacgaaaccgccggttatcatattgatttatcctaaaataaggagcaataaataaaagtagcccggggataaccaaccagagatcattatacgtattgactcccgaaatcttacgaaccatccccaacaaagagatatttgtataaggagtaaataaattctctacattcttatcgagaagtacctcataccatttcacgtattgacttgccacatattgaggagacgtatataacatcgggagaacatacaagactatgccccagaaaataagtcctttcaaaaaagcgatccggcgttttgagaatagcaggaaagcaagaccgacaatgccataaatcttagtcatcgtacccaagacaatcattagcgccgcccaaaactcctgtttccgctcaataaaaataaacgagaataaaatcatgccggctatggctatgttaaattgctgcataagaacacacgtaaataactcattcaagcatacccaaataacaaacgcctgtttccaatccgccaatccgagtttacggatagccatataaagcagcaagctattcgcgagacaccatagcaacatcccgatataaggagagaagagggagaaaggcgctattatagccgtaaaagggatcccgtataaaaaccggtcgtggtattcatccggataatacgcataaaggtttttcaactctaacgcatggaaaaaggaagccctataaatcataaagttattataagtccttcccacaggtaatttcaataagcaagcgacaagggccgtcgcaaaccaaacaaatccgacaaacctcggattcttaaatatcgggcgtctaaaaaatactctcaacatatccttttttattcgttacaactccactttcaaataaaacttctgacagcctatatgttcaaaagactcgccaacgcataaaaacccctatctaaaacagtagaaaaaacgtaaaaagcatttttttaagtattatcttcgcgacatgggaaagaataaattagctaagtttgacgatatggcgggctatccgcacgtattccaataccctttcgccgccctacaagaaaaagggtttgatatgaaaggacagtggcatgaacgttttttcaagaacgaccatcctattgtcttggaattgggatgtggaaaaggggaatataccgtaggtttgggaaagcttttcccaaataagaattttattggtgtcgatatcaagggagcacgtatgtggaccggtgcgaaagaatcgctggaaaccgggatgaagaacgtggctttcctacgtacgagtatcgaattgatttcctatttcttcgctccgggcgaagtagccgagatctggatcacatttccagaccctcaaatgaaaaaggtcaacaagcgtctgactggaacccgttttatgaaaatgtatcgggaaatcctttccggagatggtattatccatttaaaaacggacagtaacttcatgtatacctatacgtgcgagatggtaaaaacgaaccattatcccgtattgttcagtacagacgacctatatcattccaatctggcggatgagatcttatccatcaagacctattacgagcaacaatggctggatcgtggcttaaacatcaaatacatcaaatttgtttgtgaggaaagagagcgattggtggaacctgacgtagaaatagagttagatccttatcgtagctttaatcgcagtaaacgaagcgctttggcttctggtaaataaaagaatgacttaaaaaaatcaacagatatgacaatctatccgaatctgattattgaggcgttgaagaacgttcgttacccgggtaccggaaaggacatcgtttccatgggcctcgtagaagacaacattcgtatcgatggtatgaatgtcaccttctcgttattattcgagaagccgaatgatccgtttatccgctccgtagtaaaagccgcggagacagctatcttaacctatgtaagcccggaggtgaatatcaagggaaacatcacggtaaaagcccgtcagttagctcgcccggaaccggataaattattaccgcaagtaaaaaatattatcgccgtatcttccggtaaaggaggagttggtaaaagcaccgttgccgctaatctagctgtcgcattggctttacaaggatataaggtaggattgctggatgccgatatattcgggccgtcccaacccaagatgttcaacctagaagaggctcgcccttatatggaagaggtagagggcagggaactgatcaagccggccgaaaattatggtgtcaagatgttatccatcggcttcttcgtaaataaaaacgacgcggtcctatggcgtggagcaatggctagcaacgcattgaagcaattgatcggcgacgccaactggggtgagcttgattatttcttaatcgatttacctcccggaacgagtgatatccatttgacaatggtgcaaacactagcgataaccggagccgtggtagtaagtacgccgcaagaggttgctttagcggacgctcgtaagggtatcagcatgttcactggggataaggttaatgtccctgttttaggattgatcgagaatatggcttggtttaccccagcggaattaccggaaaacaaatattatatattcggaaaggaaggttgtaaacgcctagctgaggaactgaacgtgccgttactgggacagattcctatcgtacaaagtatctgcgaaggaggagatcaaggtaagccggtagcgttgaacccggactcgatcacaggtaaggcattccaagaattggccgagaatgtagtcaagcagatagactatcgcaacgagcatctggctccgacagagcgagtgattgtaaccaagaaataaagatgatttatacgtatatacgtgtggtctcgcacgtatatacgtatcgtcctacacgtacgctcgcatgggcctacgcctatatacgtatcagcctacgcaaacgtacgtataaattcagcccacaatatacttggctttcttaccgcaaatcttcctgatacccaatacgatcaaccaagatacggcgaatgctaccacagaagcggcaggaatctgtaaacccaaagggatattcaaggctctcgccaacagcacgctgggtcccgtaaagaaataatgtaccatatagataccgaaaccgcatatggttaagttcgccagcattcgcttaatcgtatccgacttaacatttaccttcttcgccagtaagaagataggaatcgtcatcatcaccacattgggagaacaataatagaagaataactccaactgttcctccgtgtaagcaggcaaagcggtcgtatagcggaaaccgaagaaagtaatggcatagcctacgacaaacataggaatgcctatcccaacgatctttcctaacgaccaatcatgattccgcagataatgccccaatagcaagtaaccgttaaacccggcgaaataataaagcatactgaattcattccatgagcatccaccccaaatgtaaggagatacgaattcccggtaataaggaataaacaaagtcactccccaacctgccagaaaccataatttcgccttatccgaaactttctcgacccaagcggagaagatcggcaaataaagatataaacctatcagtaaatagatataccacatatgtacatccaacaatgagaaattgaacggtatctgggcgatatagcctaaagacacactcaacgattgacgagtcacctcttctcccgaataagggaagaaatcaagaataagttccggcctcaaaccaagcagtcccgtaaaccaaggaaataaattataaataacagaccaaatcaagaaaggccagaatacacgcaatatccttttcttatagaaaatagaagtctcttcccggaccggtagcaacaaggctcccgtaatcataacgaacagaggtacacaaggacgaagaaaagccccataggcagctccccaaaacttaatatccccaataatcggagaatctccgggatagaaattaaacgggtctgtacaatgacagcaaacaacagtaaacatggctatcaagcgtacgacatccagccaaactacgtgtgttttcacggtaggatttgttacattttgcataaagtagatcgattgtgtttagattgacggcgaaaatacaaaataatccagccgaataggagattcagctggatttctaacctctattaacgatattcattaatatacaaagtctttcctacggataaacgccaccgtacgatgtatttccgtgtacataataatatcctcatcgataaatggcacctctttccggtaatccttcaagaacttctctaataccggggaagtcctagccggacgacggaactcgattccttgtgcggcgttcatcaactcgatcgccaagatatgatccaagttgtccatgatcttaaacaacttcgtcgccgcattcgcccccatactcacatgatcctcttgcccattactggacacgatagaatcgctgctcgccgcatagcaatacatcttattctggcttaccatactagcggccgcatattgagggatcatgaaaccggagtttaggccgggattagcgaccaagaactcaggcaatccccgcaaacccatgatcaattgagcgacacgacgttccgatatatttcctaactcagccaaggcaatcgccaagaaatcataagaaatcgccaagggctgaccgtggaaattaccgccggaaatagtcttatcctcctccgggaagatcgtcgggttatccgtcacggaatttacttcggtaagcaggacattcgccacataattgatagcgtctttcgtagccccatgcacttgagggatacaacggaatgaatacgggtcctgaacatgttcctttttccgggcgattaactcacttccctccaataaccgtcgaaaagcggccccggtctcgatttgtccgggatgcggacgcatctgctggatacaatccatgaaaggatcgatacgcccatcgaaagcctccaaggataaagcggcgatcagatccgctttcttggacaggctaaacgcacgcatcaaggcgaatacgccattggcgctcataaattgcgtaccgttcaataaagctaacccctccttgcttttcagcttcacaggcttccaagcgaactcgtccaatacgctgatcgcttcccgtttgcggcccttataataaacgtcacccacgccgatcagaggcaggaacaaattcgccagaggcgccaaatcaccggaagcgcctaaagagccacgatcatacacgatcggaagcacgtcattattgaaaaagtccagaatacgttgtacggtgatcacctgtacgccactatgccccaacgaaagggcatgcgctttcaataacatcatcaaacggacgatcaccggacttacctcatcccctacgctacaggcatgacttttcaccaagttctcttgcaaggtgctcaattcgtccggagagatattcttattgcataaagaaccgaaaccggtagtaatcccatacaaaggcccctcttgctgctcgattttatgatccaagtaatcccggcaacgctggatgcgctccttcacctcgagtgaaagctccaacttcatattttgagtaagtatccgttcgattccctcaaaagagagaggctcggaacccacataatagacattgctcatatgctataatttagtcttcacccaatccaataacttttgctctacacggatagcgttcgcctccagttcatccgctttcttccgcatcattccgacgaacacctcgtcttggatggacgttaagttaattcggacattcaataaagcccccaatacacaagtacgggcagccatcatcgccacgcaagcatccgtgacggcattctgattacctttgtgagccacatagataatcgtctccattacggaaccgatctcctccgccaccctcatcggaacaatagccgcctccttcgttgcgctctgtatcgcattcgtacggatcacctgttcgtcaggcgtttctttcggcaacttaaaagcggagaatacacgatcataagcctcgctgtccttatcgatatattcagtaagacgttcacggatcatagccgcctcggtagcgatcgtcttcatttgtccttccacttccgcatatttctttttgccaacagtcagatgggccaccatctctgtcaaagctgccgctatagcaccattcaaggcagatatacttccaccaccgggaacgggagcactacccgccgtttccgccaaaaaatctttaattgtcaagtctgctaacatagtattttgatttaaatgattcaacaattcttatcttacatcatataaagttccccgtccttaattacggtatccacgagattcattcccacatgataaggtaggaacttataagacgggtatttcagcaagatcacgtccgcacgttttcccacgctgatacttccaatctcggaggcacgtcccacagctgcggctccattaatggtcaatgccgttaccgcttcttcaggggtcatcttcatatagatacaggccaaggctatcatcatcgggatcgaggcggagaaacaacttcccggatttagatcggaagctaaagccaccgcgcaaccggcatctatcatcttccttgcaggcgcatacggctcattcaaggaaaaggcagtcagcggaagtaaggtagctacgacacccgctcttgccagacgtttgatgcctgtgtccgatatatgtaacaaatgatcagcacttacacacttcaaggaggccgccagttccgcccctccgaaaggaacgatctcatccgcatgcatcttcaatttaaaacgatgatgacgggcggcacgaagcaagcgctcactctgttctaacgagaaaacgcctttctcacaaaacacatcacaaaatgtaaccgtatgttcggctcgtatggcaggaagaacttcctcgatcatataatccacataatcgtccgtacgaccggcaaattcaggaggaacagcatgagctcccaaaaaggtcgatacgacatccatcggatgagactcattcaggtccgacatgacacgaagctgaactaattctgtttgcaaatccaaaccataaccacttttcccttccgctgtggtaacacccatggagaataactcatccaaacgttcttcccctctgtcccatagtgtatcgaaatcactttcacgggtagctttcatcgtattcacgatacctccaccacgctccatgatcgacatataactatctcctcgcaatcgccaagagaactcctcctcccggtaaccgccaaagataaaatgcgtatggctatctacaaatccgggtaacaccgcttggttctccgcccgaatctccaaataatcctccgcatggatgtttcgaagtacctcctccgtaggtcctacatgcgtaataaccccatcagacatcgctacggctccatcctcgataacgcctaaatcagacatctccgctccccgtcgcgccttatccccatggcaagtgacgatctgggcagcattcctgattaatatcttgctattctccatacgctattccataatacgggcttccagcacctgattcattgagaaatcctccaatcccaaatagtaagaggccgtatcgatcaacgcctccataggaaccaagccgataatctcgctccccaccaccgaaacaccatatctgcgagcttcgatacgaactaactcgaaggcccggtacaaggccgtacgggtataatcggtcatattaatagagacctgtacgataccacgttccttcaactcaacccccatcgctttacaatagcgtaaacctccgccgatgaaacggattttcttcgctatatccgtagcgatatgcaattgattcgttcctaagttcacattataggcgaccaaaggcatgcgggctcctatggcgaccgtaccggctgtcggatgtctttcggccggaccaaaatcaggtttccactccggttgatggattttctcagccatcccctcaaactctcctttacggatcgccgccagattctcccggtaaggggcggaagctgatttctcatataagaagacaggtacggcataacgagtgcccacttcctcccctacttccttagacaaggcgatcgcctcttccatcgtacatccgcgaattggtataaaaggaacaacatctacggcccccattcgaggatgttgaccgctatgcttgtttaaatcaatcagctcaacggcaactccaatggcctccaatacggcttgttttaaagctactggctcccctaccacggtaacaaccaagcgattgtgatcctcgtcattactatagtccaacagtttaacacccgtcttagcccggaaaggcgctacgatcttatctatcttctccagatcccgtccttcactgaagttagggacacattccataatcttattccaagtactcatacctttttatttaatgatgtttgtacgatttcatgaataaacgccctctccgggatatacggaagggtaatatgatactgttcgccacggttctcattgaaagtagcgctcgtacgcatcgcattcgggttacgggcccatgagcgacgagcgacaccccccatcacgtcccatatcatagcggaacgaagtatctcgtccacccgctcactaccatcgagaaccataccaaaacctccgtttatcgccttaccgataccaacccctccaccattatgaagagcgaccaagctcataccccgggcggcatttccagcaaagcactgcaccgccatatcagccatcacattgcttccgtcccgtatattagaggtctcacggaatggagaatccgtaccgctcacgtcatgatggtctcgtcccaacataatcgggcctacctccccatcacgtaccattcggttaaactcaagggcgatcttcaagcgcccctcagcgtcttgatataagatccgggcttgcgtacccaccaccaaacggttcttctccgcgtcacgtatccaattataattatccatatcctgccctcttcgagtcggatcgatacacgccatagccgcatgatccgtgcgaatcaaatcttccggcttaccgcttaaacatacccagcggaaaggaccgtacccataatcaaataattccggccccatgatatcttccacataagaaggccatataaaaccatctttctcgtccacaccgttacgggaaatctcatgtacaccagcatcatagatcgctttcatgaaagagttcccatagtcaaagaaataggtaccccgggcaaccagacgcttgatcacctcgaaatgtctcttcaacgttttatcgaccaaagcacaaaagtcttcccggtgatgagccaataattccgtacgttcctcaaacgtcacgcctaccggacaatagccaccttcatagaccgcatgacacgaggtctgatcactcaaaaggtcgatggaaagcccctgtttatcggcatattccaataaatccacgatattgccatgaaaagcgatagagatcggttctttcttacgaatcgcctcgtcggctaaggagaaagctttccccatatcatccgtcacatgctggacccatccttggcatcggcgtgtctcgatacgggaagcgtctacctcggcgattatactggcagcaccggcaatcacggcggctttaggttgagcgccactcattcctcctaaaccagaagatacaaacagatagcctcgcaaatccttatcttgtggaatccctaatttcttacgtccggcattcaacaatgtattaaacgtaccgtgtacgataccttgcgggccgatatacatccaacctccggccgtcatctgtccataattagcgactcccatctgggcggcgacatgccaatccttttggttatcgaacattcccaccatcatggagttcgtgataatcacccgtggggcatccggcttggaatgaaacaatcccagaggatgcccggattcgatcaccaaggtctgctcctcggtcagctcctccaaatacttcttaatcaaacgatattgcatccaattctggcagacctgcccagtctcgccatacgtaactaactcataagggtacaaagcgatatcaaagcaaaggttattatcgatcattacttgaaaggcctttccctcgatacatttacctttatattcagagataggcttcgctttcaagtctccctgcggacggtaacgataaccatagatccgtccccgggtcaataattcctccatgaactcaggagctagcttctcatgtaattcaacagggatgtaacgaagcgcgttcatcaatgccgtttctgtttgagcgggcgtaagcgaatagccgcgatcgggagcacggcgaataccggaaacgaaggaaggatattccggcaaatagttatcaagatgtatttccataacgtgaatgatttagtaggtgcttacaatctgcaaggaatttcacggattcagcgccgacaagttagcgattatccaaatcccagccaattatcattccatgtttagaagcataaaaaaaaccccgtcatctgatcacgtccgacacccgcacgaatattcgacatccggtaattatacccgatccgctcatgtgagcgaggccaaggtaaattcgcttgttcatcgctatttattaatgcagtaggtataaaaaaacagcctcacgtaagaacgcaaggccgctttatatataaaaattcataattcatgtaaggtcagagccattgcttctcctataatctccagttcacgctccactgcccgacgcaacaacttgttttgctcgtaagcgatgaaatcccttttctcacccaaatattcctcaatggataaaatggattgctggatatcatagagatatttctgaatactacgatgccccataaagtaattgtttgccttgttcgatatctgcgatgaaatagggattggataaggaacgattggtcaccaagtcgatctttctcttgaataactcaaccaatcgggctcgtaaggaaaaataattatcggcatattcctccaaggagatggacggatcgaactcaatcaagagatcgatatcgctgtgctccgtaaatctcgaagtattcacagaaccaaaagaatacaagctccgtaccttgtagcgcttgcatagctcctttattatatccagccgatcttgcaaaatagaattcatatctttcctatccacgattcaatcacaaacataacttattttttcctataacacaagtttttccattaaaagccaggacaacagtaccaaaatctcctaaaaaatatgtttagcgacataatagatacataaacctatttaaattaatagagtaagactttggggcgaaggaaaagttcagctaaagaacacaaaaaaaggtgcatcaaaatgacacaccctcctcgtaacaaaaataagatctttatgattagcctttacttaggcctacgcattgaaacgaatttagctcatgaaaactgttaaaatcaacgctcaatcaagccccttatacctccaacgatatactcaatatcccgatccgttacatacgggccggaaggcaggcacaacccaaccttaaacaaagattcgctcaccccattcacataagccgggcaatctttatagacaggttgcttatgcatcggtttccacaaaggacgggattctatacccatcgcgtcaagtcccacacgcatcgcctcgacattggcattcggctcgcaatccgtatgtgcgttaaccgctgcgtgagtcacaccgcccgcaccaccaacagcaccttgtaccattgcttgataagcattctcctgccctttcaccctcaataaaggatccaagacaatcgtattcaaccaataattactatcaaaacgaccggaaggattctcatgcaaggtaatccctctcacatccttcaacagctcccgatataaatcacacgtatgcttatgatgagccacatgagcatcagccaccgtcatctgaccacgcccgatacccgcacaaatattcgacatccgataattatacccgatccgctcatgctggtaatacggataagcctcccgagcctgcgtagcgtagaacatgatctcccgcttagcctccccgtccggacaaatcaacgcaccaccaccactggtcgtaatcatcttattcccattgaacgacagcaccccatattttccaaacgtacccaacatacgtccatcataacgagagccaaaaccctccgccgcatcctcaatgaccggaatcccataccgatcagcgaccgccataatctcatccaccttataaggcatcccatataaggccaccgggacaatcgctttcggtgtttttcccgtcttctcgatacgatcttgaatcgcctcttccaacaacacaggatccatattccaagtatccacctccgagtccacgaacacaggcgtagcccccaaataagtgatcggatgcgaggaagcacagaaggtaaagctctgtaccagcacctcatcccccggcttcacgccacaggcaagcaacgccaaatgcaccgcagcagtaccggcagacagagccaccacatgtttaccttcacccacgaattcctccaaatctttctcaaatccattcacgttcggacctagaggcacgacccagttcgtatcaaaggcttctttgatatacatttgttctttgccgctcatgtgagcaaggcaaagataaattcgtttattcattattattgtgattttagaaaatacttcggatcagcataaaagcctcagctctttctacgctaattgtagcacctctatatttcgccaaagcttccaaagcctctaaagaacgagaactagggaaccgccttagttgagattgataacactccatcgctctcaatttcattttcattccatcttgactacaaggaatgaataccgtgggaataaaagcatcatccgcataaggagcagcccattcagtttcagataacgtttcataggtataaactcgcttaaccgtataatctccaacaggacgacaagcgactaatacactgtcaaagaccatccgatgatctttatgtatatctcctctatggggaataaacactgtatctatttgattttcggatatacattttgaaacttcacgagacatgatataacctggatattgatctaatgcaggagccggaaaatcaaagaaaaaggtctgttttacacctagtaaacgatgagcctccagtgcctctgttctaacacgctgaatacctttttcggaaaaaatatttggatcagatttactggcatttgtcataatcagcacatacacattatgaccttcttgcatcattttataaatagttgccccacagcccaatatttcatcatccgcatgaggtgcaacaaccaatatattcttaaacacgactacttagttaaatatttgttaataatattataaacatattcaatctcattcttcccataacgctgatcaatcggtatagggatcatataagaggatagataatactcaaaagatgtagaatcagtttccttaagcaaataattccaccaacgtccggtataaattttctctttacttaaaagatccaccatatcagatttctctacaactaatggataaacaaatggaacacaattatcatcgaaatatatatgaggattgattttattcatagaagaatataaatcagatgctaaattaaaattctcaaatcttttatttttaatataatcataaggagcatttttaagtatagcacgagaaagaatagacattctagaaatgttagacatatctatacgcttctcatttaattgtctatattgataagcagaattgcaacccacttctattctttgtaataagaaacctgctgtctcagaagataaatcttgatcatattcatcactaaaccttacagcatctgggcctactacataacagccatcaggaacgcctacaaactttctgggagaatagacattatagactccatttataggttttgcgaatagagattgggcattgtcgatgataacatttttatacccctcaatcaatgataacatgtgctctgtagacataaggccaaaataattcacaaacactattgcggtatcatcatcttgagaaatatcaagaggcataaaatccttatctatatgataataatcaactttaaaacctttaccaagaagaaaattacgaaccgtaaagcactcataataaggcaaaaggactttatttacatttagaagtctacaacaatgataaataccagctctattaagatttaacctacagacttcagagccattaaacaactcaccagtatcacgtaagtctaattccaaaaaactacctatttccatttatagcatcaaccttatcaactacatactcaaaatcaaatccacaattaaaaatataatcaagaacagacatattctctataaaatctccccataactgaggatactcaataggagaataatccatatattctaattttaatcctctttcattaaaatgggattcatcttgatacactctagcaccattgcccgaaatatatgcagtagctccaacttccaatgacaaatcaattacacgctcctcttttttagcatgagaaagcaattcagaggatctaaatattttaggtttaataccaaattgattggagataaatgtatttaatgctatattcaaatctgccacattggaataatcatttagatatacctcttttaaagatggataaatatcagaaaagaaaggagctttcttataattcatctctattgtcttaagatgcttttccttccatttcaattcatctttcggtctcacatgattaataggatcaccaaatttcatttctacgggaaactttacacgcaagacaccttgaggggtcttgatcttattaaaattgtgagcagcctcattcgagaactgagcatcatccaagtatataaacaaatcagatttatacatcttgtaaaagaatcccaaatatggaatataatcaggctgatgtattgctactttcataagcattatttttttctgttctttcttcagataaagactttcttacatattcgccataattatcatttttcctatggattaaaagtctaaacgttctaaacaatatttttaaatcaataaagaaggagcaatcttcaccatactccgcttcccactgtagttgttcatcccaagttggagtaggattatcctttaaaacttcaggaggtaacaaacctccccttactttaaatctttttttctcataatcagaaaaatatatattgtatttagaaggcattggtcttggccctatgatagtcatgtctcctttcaaaatatttaataactctggtaactcatctaaactggtatttcgcaaccaactgccaaatgaagtttttctcagttcatccggcaaaagattcccatctgaatcagttttattagtcattgtcctaaatttcaataaactaaaagaacgtccattcaaagttgaacgctcttgtataaagaaaattggagatcctaatttaaaccgaatcactactattagaactaaatatatgggaatcaaagctacaatgccaaacaatgataaaataaaatctattatcctttttatatatctatacatcatactactatatataaaaacatactcagattattttttttcactttccttatttttcaccaaagttccaaaattaacaatctggcttttctcgcttatctctattcctgtcctaataatccgagctggatttcccgcaataagacaatgactaggaaaacttttcgtaactacactaccagctcccacaaacacatgatcccctaatgttacgcctggagtaattattgctcttccaccaatgacacatctctttcctatatatgtatcaactttatttttacccctaaaataatcatgagccaataacataaccccaaccgacacccttgtctcatctccaatatgaatacccctaggatttactttgtccatatctatcctctgagaaatagagacgccttttcctatatcaacttttttgacatatttcaaataattggtatatataccacgaactaccttactaactctttgccgaaatgttttcttttccatataactttaatattaaattatcacctatcaacttaatcttaaatgcttacaagcgttgacacaatcataggtttcgtcttcacccacatcgtcccccaactcaatcccagtccaaacgaagacattaatagtgtcgtttctttagtcctaagttgatctgcgatccttgttaccatcaatgaaggaatagaagcacctcctaagttcccaaactcttccaaattgtaaggcactttctctttgggcaacttcaatttcttcacgatacgatccacgatcatcttgttcgcctgatgaatcaagaaataatctatatctgtttcacgattgatattataatccgctaagaaagcctcaacggatttaggaggacgagatatggcaaatgagaaaacattcataccatttatcaacgtatgaataggcgcacgcacaataccattaccaaaatcctcatattcaaaagaggcaggagtagccggatgacgaaaaccaccatgaggggtcatcagagcctcatatccttttccgtaggtatggaagtctactacaatatcgttagcggcctcatcatattccaatgcgatcgccgtaccacaatctccaaataaaggtacacggcttttgtctttcatggaacccattcgcaaggccgtatcccctataagtagtaacgcacgcttcacattacccgccgtcaacagattaccggcaaccgttatggcatacatacaaccacagcatcccatgggtatgtccatacagaaacaattttccgacaagccaagcctatcctgtagcacacaagaggtcgggggagtacgataatcgcctgtaacagactctaacaacaatacatcgatactatctttctcccaccctaactctacaagcagtttttcagcggcagcctgacacatatccgaagcgcacatggtatccggggctatatgcctacgttttataccaaccgtattgtcgaacacatccgcttcctcttgagaaagaagtcctaattcggaagttgttaccacattcttaggaacagccatagccactcctttcatgccaacattcttaatttcccaccttgccataagtccaaccgttaaagctcaacatcgtacttcttcaagatctcacgtcctttaccatatgaggtaaattccatgatatcttccgggtcaaacataatatccaaagactcttccaataaagcgattatattcaattgatgaacagaatcccacgcatccacgctgtcttttgaaaagccatcatccaacaccgcgatctccacaccaaacacttctacaaaagcattattatacttctctatatttgtcatagctatttacttttatgaatttaacttactatacaatatctttcccgcctcattcttgggaatttcatcaatcacttttatctcaaatgccgaggccaccaatttggttttttctaccaacacctcttttaccaccatcgcatatcgctcatcagtcaagtaaacggtcatcttctcatccgtacctacgcaagcacattctatcggatattttcctttgattatctgctcgcactcatccaatccgatgcgcataccgaacagtttcaagaaacgtcccatgcgccccactatgtagtaacagccatcctcatcccgataagccaaatcaccggtacgcataaaaccattgcgttcatcacccagcgacaggtcttcccgactacgggcatatcccatcgtcacatttttacctcgataacacatctcaccttcggtattggccccctctatacgatttccctcactatctatcaacgacaactccgcattaggtacagcccggcctatactgccgactttctcaatggcccattccgcaggtaaataagccatacgagcagtcccctccgattgtccataagtcgcgatccagcgtttcccgttgtcacgacaatattcggcaaacttcaaattcaactgacgagacattttaccaccaccttgagtaagtaaggtcagatccggcaaatccatccggaaaaagcgcattaagttcaatatctcaaaactgtaaggcactcccgtaaaactagttgcccgttgttccttcataaagttccaaaaagccttgtccgtcatgctctgattcgttatcaatacagtagagcccacatacaaatgactgaatacgactgacaatcccatcgtataatacaaaggcaacaccagtaagggcctgtcatcagacgtaagtccaaagaaagtcgatatattcaaagctgccgcctctatattctcatacttatggcgtaccaacttaggacttcccgtagagccggaagtaggtaacaagtgagacaagtcggcatgtagcgtacaaggctccatacctgtatgcaacaatgtatagccatagcactcacacacgatctcatatcgcaatgcggatgccattcttgtaggaagacacacataagagggacggtatatttcaaacaaattatgataaagcccctcctcgatatgagcgttcaatatcaaaggcacattacccgaatgaatagaccccatgccccacgctattccccccacattgttttctgtcaacagaaacaataaggaacgtactggaagcaaagagccgatcctctctgaaaaggataacaattccccatacctcaagacagcccccgaagcatctattgcggcaaccgcatcctgcggtcgctcattcaaacctaatatcatctgattattttattctaaatggaagcgcaaccatccacgcccaatatctgaccggaaatataggaagccctgtcagaggcaagaaaagcacaagcgttcgccacatcttccggtgtacccaaacgtcccaaagctattttctgaatacgtgtatcaatcttctcaccactctcctcatacaattcagagaatcgttccgtcttcacgatacccggcgctacggcattgactctaattcccaaaggagctaattccttagcagctgatttggtaaacgacataatagcccctttggtagccgagtaggcagactgaccgggagaccccaatactgccgtaacagatgcgatattcacaatcgatccaccaccattacgagccattaaacgagataccaactgtaccatttctatgactgcaatcacatttacccggaacatctgttctgtttccggtcgaacaatcatgccgattttcttattaaacaccacaccggcattattaaccagtacatcaatacgaccttctcgtttgaatatcgacataaaagcagacttgacagctgcagcatccgtcacatcaaaatacaacggtattacaccgattccttgtacagccacacattgttccgcccatacatccatacttccttcttgtaggtcacaagcatatacaatagcaccatcaccgacaaaacgttctgctatcgattttccgataccctgtgcagcaccggtaatgatacatactttattctctaaaaatcttcccatctctattatttcaagctacgtcctccatcaatcactaaatgggtacctgtaacccataatgaagcatccgacaataaatagataatagcatgagccacctcttcgggctttccatagcgttttaacgggtacacgtcgatatctttagctacatcttccattgtcaaaagtttattttctatcaatggtgtctgaatccttccgggatgcacagcattgcaacgaatacccttaccggccaattctaaagccgcatacttcatataagtactcaaagcgctctttgaagccccataaattccattggcaggagccacattaccataagcggaaatagaagccgtaaaaactaccgaagatggattcttcatctttctttttcgtaccaataatttcatgagaagcatgggtgcaaatacattgactccaaatacttcctccaatacttcagacgaatagaactgtacaggaatcatctttcctataccggcattacagacaaagccatccaacataggcaaagaagcaatcaattcaccacattcgtcctccttagacaaatcagcgacaatgaaccgatgttcctttcctccttcaagagtttgaagcgtttcatgcaaattttgtacgttccggcctgtcagtattagagttgcacccaatttagcgcactctatagccgttgccctaccgatgccggaagaagcacccgttacaagtatcgtcttaccttctaaagaaaaaggattatacattacagacgagaagataccaaattatacaaatcgccaatggttacctgtttcttcatgtcatcacccgtaaccgtcacattatattcttcatcaatcatggagataatcatcagagccaccaaggaagtataatcatccaactcatgaaacttagtttcagtagtcaataaaccagcatctacatcatcaaattgttcagccaatttctcgataaaatcagtcatttccatattcttatttatttagcttttacattaatttcttagccggattccccattacagttgtaccttcttttacacgccttataacaaagctacatgcacccacatgtgccctatcttcaactacaactccatgattcaagacagaagaagtataaatatccgcttcattccctattaccgttcctcccacacaggtaacatgggtatcaacccggttccagtctcccatctgtacatcatgtcctattaccgtataagattgtatcaaattataactaccaatctttgcatctgccccaatactggtgtacgctccaactatatttcctacacctaatttcacatttgttccaatacgtgccgtgcgatgaattagacttataaataaagcacccttatttataagctcttccatacatttcttgcgaattgccccacctatagaacatacaaaaacatcatctttttgtggaatataagtacttattctatctaaaataggaggatagtttgtaaaaccatctaaagcatagaggttgtcatctataaatcctttcacaacaaactcctcgccataccccctactctcacgagacatgtcatataaagtacgtcccatgcctccagcggcaatgattatgagatttttcataacgcttagcttataaatcaatattctttgatcaaaatcatctataactcacttaataaatttcaacctcaaacaactcctcaaaataaaatacaatagtttaggagaaacatacaataacataaaataatatttagcaggactactccacgaagtcatccgtaccctttcctttatatactttcgcactaaagaatctgtatatacataatcaactaaatcacgagccttacctagtgctacaactttcacatacttattaaaaacaaatccattaagcaacttacaaacagaatatacaaaacatttgctagttactattttacattcggatttacggactcgttcatctatactatataatgtatcaacaattgataaatccacattcatatttagatttttagtagcagaatctatatgtcgaacataattataataaaatctatcagtaacatatattctatgcgtattaagcaatactcctataaaaaaatcaaagacctcacctacttttatatttgtattaaatctaacatttttaattatttctcgcctatacaacttaggtgtaattggaagataatctacaaacatcaaaatattttcaagattatataccccaacaggaatattagtcaaacaaaaatgtttgattccattcactatattgtaaaaattaaaaatcaaaatatcagcatgatatttacttgctagcacatacatctcttcgcaccaagaagcatcaataaaatcatccggatccaaaaaatacacatattcaccacgggcaacatcaagggcatcattccttgctttagatacaccttcattaggtttatctataacaacaactctatcatcttctcgttcaaatttctttatataatttaacgtatgatctgtagatccatcatttacaaatatgaattcaacgtcatcaaacaattgtttttttaagccatctatacatatagaaatataattctccgaattataacatggaataacaatactaatttttttcatacaggcataaaatgaaagggttcattcttaattgtagcagcaaataatattagcaataatacaacaaccataaaaagaacagcggcattaatactctgtcttgatttcttatacaagaagaatatcaaacacgctataactacaagtttaaatcctctaaaataacgaaacggcctagctaaaaccaaattattaacaaaaacaatctgagccaaagttccaaaaaaatacaaatcatatattatattaaatttcctcccataataatagcatttcatttttttacaatatgatacaataatcagatccaataaaataaaaacatacatacttacacctgttttcgtaatatccgcaaatcgataaagcacatcttcagtatacatttcatatccagaaagtgtagctaaatagaatatagtatcatttatatttgtcaacaaatcaacattatatatagcaacataagacacaacaaaaagcaataaatattgaacattaatactattaaaatagtgatcttttttcagatatagaaaataaaatgggaataatataacagcagaataatgaaaaccaacagaaatcaacacaagagtaaagaatcctacaatcctcttatctataacacaagtaatagcacataagaatatacaacctgcaatatcttgtcgaataccattcatccaatgaataaagaattgacccataaaaagagatacaatcaaagcaggatacaagaatttacagtctttcataaaatagaaaagacaaaacacttgaatgaaagcacaaaccgcaaaaaaaacgattggatgtacacctgcattactaagcgtatcacgaattaatgcgaacaaaggttcatattccttatgaagaaatggatttatatatccatctaaataacctaaatgatcttcaccgacatcgtatcgcatcccaaatacaacagcaaaagaaaggagcataaggattatctcccatctaaaaaacagatttttatgtatagttacatgctctctataagatgcaatagaagcacagcaaaacataaaacacattataaatgtataaataaatactgaaagcacgatatcaaattataaaagacaggttatccttaagaatattttcatttaccgttacatccataccgtcaaccattcaacgcctctcgcaaaaaatcaagactcttttcacgccactccaccagcttaccagaatgatatttttctaacaaatcagcaaaacgaacaccacctcttctctcattcacaacacaacggaaaggtttttcgaaaataatagagaatactgttccatgaaatgaatccgtaattacaaaactagcatcacgaaaaatagcgatccattcctctattgtcagcttggcctgtccataagcggaataacgaaggataggcaatcctctttttttcgcctcttctgtgattatcagatctacttcctttgcggaatctagcacataagcagcaagatatctcttcttaaaaacaggaactttcatacacaactccgcatatgtctcctttctaacaagtaacgtgggatcgagtactgccacagcatctattcccaaatatctctcgcaaagagccactccacttgtctctcgcacagatacggcatcaaaaagctgagctaaagaggaacaaacggaggtttgtttttctgaatattcccaatagtctacgccaaaagaagcagcataggcaaccctttttcccgaaaaattccccgcaaaatgcaaaaacatatccgacaaacgattcacattatatatcggacgccacgtttgatcactacctaccaacaatgcttctaaaccatattctctaatcatctccatcgaataatttctacaagtaggagtcttgataatatttttactcacaaattcctcaaatagcggcatccttctctctctccatctcttaaatcttctcctgcgtgaaggaataaaccaaagaagcaaggatttgatcgtagaaagaataaatcttccaatcgaaggacgaggaaggatgtcaatagtaatcggctcatgccccaaccgaatcaagatatgctgcaaggcccaattctgtaaaactccgccataattacctctaagaggttgtgtcaatattcctattttcatgatccatatttttatcttctttcttattttagttaaaacaggataaacaagttcttctttctcagtcttatcaggtcaagtaagtagagggactttcatactgactgtctctagaaatgcttgtcagatttgaatgtgattaactaatacgttttacactctttaggttggttcactaagatgctatacaacttccgttaggtgaactaaacagctttacatttagccttgggtaaactaaatggctttacaacatttgctgacagatgagtaaagtgtctcatcttcgtcttgggcacaaatttagcaactaacattcactaaaaacagtgacgaaagaaaccacaaagcatcatttgaacgtaaacatcccaatggaagaacgaacgtgaaaagctcaaaccattttacccctccatgttaatatctattaatgaataatccttacaataaacaaagggcaaagaaatgacagaccatgttatcagcggtatgataaacttcttaaccttactcctaatatacttcatctcatttccattctcagggcttttgaagaaaaagccgctaaaaaaataaaaagaggacataaaaaaacttagggcattaaaatagaattcggatgcggcaccttttgcatcaaaaaaaccatatattataaaaatatgcaggacgaacatatgcaataagcatacaccttttaccgaatcaatagaatagtctctcaccattgttcttggattttaatcatacataacaacgaatatgaacattcaaaaacacattctttcaattaatatactttaccggatatccaatagccaatcagtacgttcaaatcaagacacccccatctacagggattatatagccaacaatttgccttgcttcgccactagtgagaaagagagcggttttagctatttcctcaggcattgtaaaacgtttactcggctgtccttggaaataagcgttgtcttcaaagttcctattatgaggcaacgctggattggaggtaaggcatgtgccaggcgcaataccattcaccacgatatcataagcaataagttttcttgcgattccaccagtcaagctatgagcgccccacttggccacggcataagggtcgaaaagtctttggtagccggcgatagaggtaatgttgagtatattccccttgattttattgtctatcatatacagcccttccatttggcacatcaaaaacatacttttcgtattgatatcatatgtcctgtccagtacttccgcagtatatgcattccacggttcatacttagacatcccacctcctacattgttcacgaatatgtcgattctacccatcatagaaacggcttcatcgaacttctgcttataagagtcaaaatccaaggcgtcccataccaacgtataaagcttggcattactttcggaaagctggaagtttgacagtttttctttacttcttccagtcactataacctcagcaccctctgccaagtacgccttagccatagctctgcccaatccctcgctaccgccagaaataaataccttcttattggcatatctggcatcaggattggtaaatgtaacagagacatattttactcccccgtgtttaagggatttcaagaaattcacgatgtaagactttattcccataattacttattatctattttttccattatgtatttagtgaataatagggctcctctcttgttaagataatagcagttgcgaaacaaggatttgtcatccgaaaatccaggctcttccatacagtcgaaataccatgtctcccccccgttggcttctgtaatgaaagagtctatcagttgttctttggcagcagcgggaaatttacggcacaaagatctatgcataggtggtatgaccaggaccagccttaacttctcctctttgcaatactcaatcatatcttttaacattgatatagtcctatcatataccgttctatgactctccacgaatttatcattcaagttattgatattaaactgaacagtccatccctttatccaattctcagcatcacgctccagttgcctatctctcattatcacgtctttggacgaaaagactcgtgtccttatgtcacggataaattccaccaatgggtatatggatatagggctatttttatagccctttattttactattccggatatagtgtccaccgggaatcgttcgatagtccaaaaaactatagcaacggtcttctatgtaatccaccgctccactgatcgacgtaaacggacaaagcggataaaacacaatagcattatcctttaggaacttgcggtaccgcttgagtatcaaaaagtcgcctaccatcgtctgcggcgccacagcccagttcattcccttacatctcatatcgctgtaatcgaaatcatatacgccggaactgctgcctagattcacaacgtccaatggctcctctttcatttcccaaaatttcacgcagtctttgaaaaggacctcgttgtaccaatgagaagacttaatgaatgtattgattttgttctttatataatgtttcatgagatcttctgtattaacaaattctctgatcattgtttagtcttgctcatcttagtctgaatccaactgactattttttttctttcggcacgtgttattcctacgtataagataagaatcatcaatacgacctctgtaagcaaggatagaataatgaacctttgccatccatcctccatcaaatatacgatggccgtaggcacaattacagaacaggcaccaactaagacacatgggagaacagcgccaactaaaagttcacgtatgttgaaatgtacataagaatagacaatgaaataagcatcaatcataacagttatattaatgatgacgagaactatgaacaccgcataggcaggagcacccattttcaatatggcataactaataggcaaggacaatatcattatggttccattgagcgaattccccagcttcatcttgccgatagcgtgaaaggccataatcatggacgcacggaaaacctcggcaagactgagtaaaagtatgatcaaagtgaatacatacgtatcaggaggagtggctttgcccagccataagtttaatatgaacctcaactcaaaacagatgggcaagattaatgccaacatcaagaagaacgaataacgtgcggacttaaacgtaagcgagtacatcctctcataattgtgttcggcaaaacttttaattacctgcggcctcgtggccataagaaaattaatcacaaaatggttgacagccgtttggatttgataagccaccgcacgtgccgcattgaccatgggaccgaaaaataagttgagaaggatattaataccttgcccttggcttattgatgccaatccgccaaacatctcccaccctgaataagccagctgccttttatataaagtcttatccgtaatccatctgaaacggcactcctgataacgccgatacgtataaaacctataaaaaaactgaatcaaaaaagtattcagcattaacaacaaagcataaaacactaagtcatccatgggagataaggaaaggaggtaagcgatagctaatcgcgaaaacgcatcatataagcctacataggcataaatagacatattttcatgggctatcagtgaagcattgtaaggtacttgggtgaagttaaccatcaccgtaacaatagaaaactgatagacccaccacgcagccgatagtcgttccaccggtataaccattttctcgtaaaagaaccagaggcctatagtctcagccaacagcaagacaataaaagccacagccatatgcaaattcaatgaaaccgagaaagttctcttcagcatctctgcgtccttcattcccaattcgtaagccagaaaacgactggttgatgaagacagggcaccgttaagcactcctattacggccacaattccacctaccgcattataaataccgtaatcctctacaccaagcgtttgaagtatcacacgggaagtaaatatgcttacccccatgacaagtaacatacgcacatatagaaaaagtgtattttttgctatacgcttatttgttgaagatacttcctgactcatttcagactgccccttttatttaaatagcattcacacgattatcattcgttcaccccgttcttctgcagcagcctcacaatactatctaggctgtcaaaattttcgggaatgatgtcaataccatcaatgacgatatcgtattcggtgtcgagagtatcgaccagcgtcactatatcgaaggaatcaagcataccttcctctataaagtttacaggctcgctgaaatcgaactcggggcgtaactcactcaaaatcgaaataattttctctctcataatctttttctcctttaatcttggcaattatatacctttatttatttctaattaatacataatcataaagtctctctacttcaaagccgtaatgacggtaacgtttaatggcattttcgttactagctatcacccaaaagagttgacgcttggtggcgtggccagctcgcataaattcattgaacaatcgggaaccaatctttaaatcccggtattcgggcaagacaaaccaataacgcagatataaggtctgcccgttcagttcaaagatgataaaaccgtaaacctttcctttttccttatatacgagcacaccctttcgggatatgaagtccagtatttcctcgtaacaaggcagctgttcagacaaggggtcaaagttggtatggagcatatcctgtaccacacatgcatcagcctcttcagcgagacatacattggggacatcgctcactttatactccaaggctccgaggcgactcatacggtagagctgttcatacacgctgaagccttgctccacaaacacatctttcagactcgcaatctttccatcacccactatgtcaacgaccagttgctcagacaatataggtaaaacagccttcaatcccccgaccagttgttgcaaggtagtggtaagaaaaaacaggttgttgaccgaatcggttaaatggagcagaaaataaccgtcagggaaagaaacgtaaaacaactctcctttctctatccatatggagtgcttcttcctatccaagaagaaattggacagatagcccttacgcaaagaacgaatatcgctcacaaagccattaatcttatcaagtgaatctatcttatccattgacttggttattatagaacaggcggtcaatcttaccgttcgtattacgctgtaactctctgatatgatgatacacagtgggctgcatataacgaggaatgctagtagagataaccttgcggaaagttgccatgtcaagttcctctgtagcctgatagaacatcacaatcttcttgtttgcaaagtcataaacgacgcaacagctatccaccatgtgactaccaagaattgcagtctctatctcgccgagttcgatacgataaccattgtgcttaatttgagaatctacacgacccacatacataatttctccatactcattctcataaacgacatcacccgtacaatagattgtctccggataataattatgtagaggattctgtataaaggctgaagcagtcttttggggactgttataataaccaagagctagcgaagaacctcgtacacagagttctccttgttcaccctttgccgcccgacgtttgcgatcaacgagaatcaacacgtcactgttgcgacacgggaaacctataggcagaggttcactatcagaaaactctcgtttcacttcatagaaggtacagtcaacagtaatttccgtaggcccataaaggttagcataacggcagttggggaggtgcttacgccagtaattaaggtgcttatttggcattacttcaccggcaaagaacacatccttcatgtatataggcttttttgtttcgaaaatattgagattggctacattgatgagcacaaaaggaacccaaaacacgaacgtaattttctcctcattgagatagtcaaccaacttggctgggaatgcgaaattactttctggaataatattaagcgtcgcaccagtggaatacataaggtaaatatcaagtgttgagttgtcaaaatagaaaggggcttgattaccaattactgcatcactcataaagtgaaacgtatctttcgcccaatcgatatagtcaattacaccacgatgcgagacaaccacacccttgggaattcccgttgaaccactggtaaaaatgctgtaaacaggatcagtatcaatctgatgagtgaactgtgaaaaagcattttctatatttatatcaccctcaattatatcttcagccacaagaatccgtacatgggtaaaatccctaagggtttcaatatgagaacgatcagttatgagcactttagattcaagagtcttgataatactgctgacacgagaaacgggagactttgtatcaagaggcacataaaagtttccactcatattaatacctgcaaaagactcaatcatcttgccccctttcggaatgtaaacaccaattgggttatttaacccgatattcgtattcacgagagcagccgaaatcttttgcgcatttctccacaaatcaccaaatgtgatagacatttccgaatctttaacagctattttcgcaggaaagcgactaacagtagactggagatattcaataacagatttttgcatatctaataaatatttttcgattcttacgagtaatggatcggtcactgtttattcagcggttcatagaaatgagttttggaaagatccagagcaacacttccacacgtaaggccagcgccataggaacaaaaaacggcatgcctcggacggtttgccttgttcaatccataaagatcacataacaaattggggatagtggagctacttgagttaccaaagtccttcatgttcactggaaatttctcttgacttgacttcaatgccattctaacattcttaataatcaactgactggattgatgcaacgcatatatatccacatcagaatcctcccattgcatcaaatccatcacagtgcggatgctcttagggccgtttactatactaaatgagaaaacccccattccatcttggtatatatacccaccatggggcatcatgatccgatcgtatctcgcaccatctgaacagagatggaaggccatgcctgttgttccttttgaaatcagtgaagcagtacctatatcgctcgcatcaatactaccaacagctttagggtcaagacaattcttcagcatatcacctccaagaactaaaacattctgacataatccactatgtatccacatggctgcttgcatcaaaccatagatataaccggtacaaccataattaatatccaagcaaacggtctcattcttcaatcctaatttatgctggagatagacagaagtatcagggagcgcccaatcacgagtcacagtcaatacaaccaagccgtctatgctctctctgtcgatgttatccttactgattagatattcagcagcgttgaagcataaatcggatgatttctgattcgcatcggttctgtaaacccattcaactcctgtcgtacggataacatctcttgtttctttttcaccatattgctcggcgaaagaagataaggaaatcttattactcggtagccagcttgcaatactgcggatagagacatctggtatgattgttttcatgcctttctttcttttacgatattgaaaagatcttcaattgtatcggcattacgcacgtcttgggtgtccagctccacaccatattcttgatagaccatcgctacgacactaagacttgttagcgatgaccaactatccagttcatgaaaatccaaatcagcttcaaaaatagcaggatcttcctcttcgaattgggaaacaaatttgccaataaaatcttttaattccatatatcaagtattttttatctaagccttccaaagaatatttttctccaccaccacggcaggatcacctttcactatactgaaagcaggtatgtgaccggaaaccaccgaacgagcagagattatggcacctggttcgattaccgccccaggcatcaccgtacagctttccgttaaccatacatgttctttgatggtgacgggagaagaggttttatatccgcgaatagatataaagtgttccccgttgttatcgcggatagtgacattacgtccacatccggtataccgtccgatagaaatatggtcagcgcatatgatcgtcaagccaatattcgcacctaaaccacctcctatttccaaagtagcgttcctgaacacctcaatgtcggcaccatacgcaacactataaggttcatatttaatctccatcctccctccgttctcaatcaagagcctgctgtccaggcgagatcctttgacacgcttacttccaaaatagaagggcgcattcagtatcagctgggctttggatcccatgactatagtacagtacttatttatgatgaagaattttccttccaaaacatttccttttacttgtccgcaaaagaagttatatcgaaagttttttgtccatgtaccaagactccatcctgaggctttttttacgctaaataagaaacgggctacgttcttaagcttttccttgacgctaaaccccttcttcccaaaatggggcaggtacttcttgatgcaggcatccagtgattcattgagggtagcatagaacgcatccctgtcgtgactagaatggcacaaaggcttcattaaaaggcgatttcctgctatggccttgtctagagggaagtcctgctttttcagagttttaatattctgtatcaagtcagcgccttttttgctatgcacaaagactacggacgttcccaaatcattgtcaagctctttaggtatatactttttatcagcccataaatcaccaatggtaatgtctgtagctctagggaaacccttgaaggggcattcaaaacaactcggccgacatacctcaggaacgatataattcagaatacgccacggattgttctccaacgtttgatattcgacatctctattttcaaagagaattttaaaagtatgcttacgccatcccaactccttgtttttagctttaaaatagacaacctttgaatgatgcttgttttccagatattctatgtacttccggaaaagcaatggcgaggctatacccctacagatataatccaccaaaatcaagttgtcataagttttgtgcaggaagccgcgcagggctgccatctgacatggacctccacaaacaagcacgggcttgccagtcttcaaggcttcacgaacagcgatataaaatccatcgaaacggctctgaagatatttgctagagcgcaaacgaggcaagtcggtcttatctgctgaaaggaactgagacactgaccagtcttcattatagaccgcaccacccacgtagccgccttgcttgtaaacgtattcggcaagggctgtgaacgctccaccagaagtgctgtcgaaacgtacctcgatattcttatgtatggcggcatagcaaacaggaatctcaaaatcatttttctttagctcttcagagtgcagattggggcagaccttttcacaaagaccacaatctgtacatttatttttatcaacttccgggtaccaaaatccctctatatcggtcttgaaagtaatagccttatgggtacatacatcaccacaagcattgcagccacagcatttacttttatctgtaatttgaatcatttataatataatttatatcgaacgtaaacagtcattttaaacctgcaaaaacctaaaatgaaatatttttaattttatttcacaataaaggggttatatgtaactattcagcaataacaaagacatggtacattgtcatcctataacgacaagatggtattgattgccttaagttgtgattgtttgttcttccagacagtgtcggcgacaaaatgacgatcctccgtcataataaactttgcatttgcgataacagcataattcaagaatttattgtcattcggatctgattttatcaaattaaacttataataaggagtaaggaagctgatatatagattgttcaaaataacatctaaggttagtttagtcatctcttttcccgtcagttgctctaatatttcttcattttcattaaggatctttcagatgcacataattcatttgcgtcatctaagaacgactgccatattcaatgatatcggtttctactcagaagactttgaatcaaactgttcgtatccaatacgattttactcatcgttcaaatctatacgaaagtgtattgtcctcagctcgtcaagcttctcctgattgagacctctcgaatcccataactcatccaaacgtttgtccaatttttgcgagaaatatttcgtcaaaaccgctttcatctctaatagcttttcctccgagccatcaaaagcaaaaaacttcaacaaatgttgttgcacgggattaaatactgtcacttccatattcttttgtttattcatccaaaatagatgcttgcatatcaaattgattgtatgaaaatatagtcaattccttttaccacaaacatttctccttgaaatattccctcctcaatccaactcctcaaaccgagaattctggctcttgaactcaggcacgaatactttcatctccctcaccatcgggaggatctggacacgaagggataattcgattaatacatggatatgtgttatcacatccttatagtcatactcacgaaccgccgccacccgaattttctcgtgaggagtctctttcgtattctccttgttgttcaatagctcctcatatagtttctcgccggggcggagaccagtgtacttgatctcgatgtctttgtctacctgtaatccggacagctcgatcatacgcttcgccaaatccgctatcttcaccggctcacccatatcgaaaataaagatctcaccacccttgcccattgtaccggcctctaacaccaggcgacaagcctccgggatagtcataaagtaacggatgatatcgggatgggtgaccgtcactggacctccctgagcgatttgttcccggaaacgggggataaccgaaccgttgctacccaatacgtttccaaaacgggtcgtaatgaaacgcgtctcgcctttcacctctcctcgctcgatcgcaaggctcaagctctgtacgtagatttcagccaagcgcttgctacagcccatgatgttcgtggggttcaccgccttatctgtactgatcatcacaaacttctccacaccataacttacagcggcatctgccatcacacgggtaccgaacacgtttgttcgaatcgcctcgcaggggttctcttccatcaaggggacatgcttgtaggccgccgcatggaacaccacttgggggtgccagttgcggaacacataatccacacggtccgggctacggacatcgccgattactgggacaaagtttagtcccttgtatttctcttccaattccagacggagattatgcatcggggtctcagcggagtcgaagcaaaccaacttcttaatcgggaaatgagccagctggcgacagatctcgctaccgatactgccggcggctcccgtgacaagcacggtcttcccttccaacagattgccgatttcgtccagattaatatggatctcctcacgacccaacaaatcctcgatacggatctctcggacggaacgtttcgcctcacctccacgtagctcctccatctccgggactaccaatgtcttcaaagaggcctgctcgcaataacggatcaaacggtcacgctcctgatgggcaacctttatattggggaagagaacgccatccaaactgttgcgagggatcaagcgatacagatcctccacgttctcgatctggtagaccggcaactccgcaatccggatgcttttcttggaattaccaaaggaaaggaagcccatgatgctataattctgcatgaatacctgacggttagccgatgtggcgatcatcacgctttcctcctccgtgccaaagaccagtacccgcttgcgtttcttaccaagttgcaggaggacgctgttatagacattgatcacgaagacacgcaacgtgaccaacatcacgatcgtcaacgtactgtccatgattccacccaaccaatagatagaagggctgaaacgggctttcaatagccaaagcagcaggaacatcaagagcgacttgccgatcgcagcaccaccgatccgccacaagccacgcagcgtggaatggcgaataaccccatgatatgctttgaacaacaagaacgaaacgatactggccacaaatgaggagaggcccactttcagcacatccggctctccaatacgtatatgcagaatggagaacattcctagtacgcccagcaacgatacggaaagcgagacgaaaaggtccgcactaaaaatgatccaacggttgatataccgcaaattcaccagacggcctaaggccaatcgccatctgcccttatgaaaatccatcatttgtattttgtttgttttatattcaatgccctaacttttcccaacggcggtgcctgtgactcgtggcgtcccgaagcggcgggcgtaatacagctttccgtccgcaagatcgtaccatcaccatggtggatgatttggatcgcatgggttgcattgggcacgatctgcacattgcaaccgtagatatggaagacgaaacgtgcttgttccgcccgctcatagttttctgtcatatcgtaattttttcagtaaggttatcacttttcgtttcccttggaaaacgaggtatatatgaattgccctgtgaagtatatatcaattgcctaacacagtatatatcctcgggcatatgcagtatatcttctcaaaaacggccagttgagcggtgtctgagacggctgctccacgcatcgttaatacgggcacggatgttgctgacgcttttacccttcgtgattcggggggtgatgggtagaaagaggcggatgaaacgctctttgaccatctcctcgggggttattttcggctcgttctcttgcatgaccagaatgacttgggccaactcggtaaccgtccggcactcgacgatctgcgcaagatagcgttccagatcctcttctttatttatataggcacgaaaacggatcgtttcaggcatgagaccggatctaccgtccccctcttcttgggaggtctccccgcaatattcccccacatagaagttctggatggcttccgtagcgttggggagtatctggttattgccgccgtgtatggtaatcgttatatcagacataaggtatatatgaatcgtttgtcaatgaaaagtaaacagtttgtcaacggttatcagcggatttgatttcgctatccgggggttgtactttcgcattgtcaacaataagtttaatctttttaaaaaaagaagtatgattaattattcaacttacatgtggaaaagtccactggatgagaccgcaaaggaacaggcgtacgccaagaaccaagtgacgaaagtgatgagtttcgatgatttcgtgaagcacatctcagatcacaacggtgttttcacacgcggcacggtaaaaggcgtggtaagcgacacctgctcatgcctagtggaacaattgctgaacggctacaaggtacaattcggcgaactgggaatctttagcatctccatcacctgcgagccggccgctacactcaaggacttctccagcgataatatcaaggcagtgaacattctattcaatccgggtatagacttcgagaacctacgttctaaggctgaattcaacctagtaaccagccgtgcgatccaagccgcctcgctgaaggcggtaaaggagaataaagacacggtagacttggctgcgttgaagaaaggagactcagaatctcccgatgagatctaaatcctgccattgagaaatacggctcttaaccatgaagcttattttattcatttatttaaagactacaagtatgaaaaaaacaaattggaagagcgtcttgctctacatcatccgcattgtcgaactggtcatcaccggtgccgccggtggagccactagcggttggatcggatgagaaccatcacgctgattatcgtgcattgctctgccaataggcagggcagcactttacggatgatggacatcgaccgtctgcatcgctctctcggctggaatggctgcggatatcacttcgttatcccgaccgatggtacgatcgagaccggtagaccccttgaacaagtgggcgctcactgtaagaaccacaatcggtacagtatcggggtttgctatatcggaggactcgccaacgatggaaagactcccatggatacccgaacggaagcccaacgagaagccctacagggtttgtttcgtgaattgcatcagcgattccccaaagccctaatcgtgggacatcaagacttggacccgtcgaaatcctgtccctgttttaatgtcgtgaacgagttttccgattagtttaacgcagggagtcccttcacctccctcgtatgccacgcttggtaggcgggagcggagagttcaggtacagtcaataacttgtaatccgccccgttctgcttagctatatgttttcgttcatacaaacgaagggaacgatccgttacggaaaccatgacaaccggaaaaggataagcgtacaggcgcatcggcgtgatctcactatccggaaaggcacgacgcaattgataagcggaacgttcgaacgcgacccaataagatcccgtacaatataaatggatcgaggtctgattcgcacactcacgattcatgatctctctcaaatgccctttcagcaatagcatcaaacggataccggagggagtttcgctttcctttctcatgacagtctactatttaatgttttagccaaatatcgtaatcgtgtaaacgctgtatcaacaaggccttgcttctcttaggcgaagggtcatcccgccagggatctaccagctcatgcgccatacggtaatacaggttgctattcgtgcagccgtaaagcgtgacgagcagcaaggcacgagaattcactgccttaaccaatggaagcatattgcgtagggtggaatacaagcgttcaaactcctcttcctgatccaacagcttataggccggaaggagtaatgagtaaaccttgcaacgcatcacgtcggtctccacacgaagggaagcatagcccttcagcacctcacgaaccaaaagttcgtcttcctttcccaatttgcccgagagataataacgccccaacgccttgtgcataccttccgataaacgatcgttatccaaatgggtataaacatgcttgcctttcgtattcaactcgatcagctcatactcgccttgccttacctcaaatagaggaacccacatacagtcaaggatacgtaccatgacatccttatgacctccacccggttgcaccaccacctcagcctccatccccatgaaagaacccgaggtgatacgtacacggtcacctttcagcaagcgaccgctatccggtacgtacaccggaagctcattggaataagattcagccatccagcgtaaggtctccatctcatgatctgacaggtaaggaaaataagagtgttcgcccacggatacccgaggaagaagattatataagggcatgatacgtttcaaacggaaaatctcattctccgaagcatggataaacacatagttgtataaaagaggcttcctcgtattgaccatcttgcctcccaccttgcgagcctcgacatacgagggggcaaagtactcgaacaagggttccccacaacgtttacgacgggaaagctcggcatctaatccttttgacgaatagatattatcacgtcccccaacagcggtaggaagcgtcagtacgtaccagcgtacagcctcctgactacggcgattgcgtatatgcaccatagctctatcagagctattacttgtcacgatattcattgaggaagataattcagagccttatcaagatattcttgtaataccctgataaataaatacttatgtgaaaacaaaaaaggaattactgaaaatttgcatcccttcaatactcatgctacttggcgagtagccttaacaagaggagtgaaaggatattccttagttgtagagacggagcgtgtcccgtttcatccccttacaatggtattttagttactatcaggcggtgggagacggagcacgctccatctctacatgatgttatatggaatttacttcggataacgtgatgatttcggaaataacgaggccatttcgtttctattgccatgtctatacatcagaaataagaacgaagatttaaagagaattaaggttgaaacacaaacaaagcctaatgtttgcttgtgttatgttattttttactacatttgcggcatgaaatgaacgctactcgccaagtagcagtcagtttggctactcgccaagtagcgtacttttcttcaccctactttcggcgcataattatacacactctcgaaacaaagtttgtttacggttgagagtttttctaaagagaaactcttcaagtatatttgcgtagtcttgatagatttatgccctaacagttcactgatcatctcaatcggtacgttttgctccttcaaggtcgtggcgaaagagtgacgaatcgtgtatgaggtaacccgagtatgaatgccaatggattccgacagtattttcaatctgcggttaaaacctcctaatacggtattatattccttgtaggcatcctcaccggtcttcattccctctaaaaaaggaaacagatagggcgaatcctcggttgtatcggctgccaactcattcagcagcccttgtgcctccgctgggatctccacctgtataagggatccgcttttctgccgataataagacaagatcccttccttgatatcctcctttcgcaaatgcgccaaatctacgaaagccatcccgcaaaacaaaaacatcaggcaaaaggctgattgggtcctcttctgttgcggatctgtcaccgggcttgtcatcagcaagcgtaagctttccgaaggcaacgcctttttacgtttactctcaacccccgtaaacacatgcttaaacaaatgaggaatataggcagcctcacccacctctaccgctaaattatagatgtgacgaatccggcgcatataagtagataccgtgttacgagcacatcccttggccaacagccaagattgataacgcaaaagtgtatcccgattaatatacgcataaggaatctcttcccggccacaaaaacatttaaacgacctcaacgcatcttgataactcttcgccgtggaataacgctttttctcacgcaggcaggtgatatacgtaagtacacccaccacaaaatcattctcattcatactttatctccttaagaattaatacataaaaaaatcctctatctctcgtttacacaggaaagatagaggatcttcataaaatccttaaagaaatatattattttccggctttctcagcagcagctttcttattgatcttcttcttctgcaactcgtaagcgatcggagtagcgacgaacaaagtagagtatgtaccgataatgatacctaataagatagcgaacgtaaagcttcggatcgtgctaccgcccaagatgaagatacacaatacaaccaccaacgtagtcaatgatgtattaaatgtacgacacaaggtagagttcaacgcatcattgatcacttgataacgatcacgcttcggatacaaagcgatcgtctcgcggatacggtcgaatacaaccacggtatcattgatagagtaaccgataatcgtcaagatagctgcgataaacgtctggtctacctccattgagaacggaagaaccttccataacaaggtatagaaagaaatgatacacaatgtagtcgtagcaacagaggcgaacgcacccacagagaatgacacatcacggaaacgaagcaggatataagcggccatacagatcatggcgaagattaccgctaagatagcgctattcttgatatcgtctgccatgctaggacccaccttctgcgaactctgtatgaaagtagtcgtgaactcatctaatgtagttccttccggaagtaaggatttcacgccctcaaacaatttattctcgatctcttgatctaccgtaggatcgttatcattgatcttatagttggtagacacacgtacttgatcagctgtaccgatctggataacactaacagaaccgtctaactgagcgtccagcatattacgaacatcgtcagtcttcacctcttgattgaaacggatcacgtaattacgtccacccgtgaaatcgataccattattcaagccgatcgtcataaaagagatagcacctaaaacgatgattgccgccggaattaaataaccgactttgcgagcacccaagaaattgatcttcgggtttgtcaacaagtctttcgtaatagaagtcgtgaatgtcacgttcttcaatttatctttcgctaacaatgcctcataaacgatacgagtcaagaacacggctgtaaggaatgaagcgaacaaaccgatgatcatcgtcgtagcgaaaccacggataggacccgtaccgaaatagaacaatacgataccggtaatgatagatgtcaagtttgagtcgaagatagcggagaacgcattgctgtaaccgtcggcgatagcctttcctaaagacttaccggcacgaagttcctctttcgtacgctcatatatcaatacgttagcatcgactgccatacccagcgtcaacaccataccggcaatacccggcaaggtaagaacggcttggaaagaagcaaggatacccatcgtgaagaagatgttcaataccaaagcaccgtcggcgatcaatcccggaatcaatccgtagaatgcgcacatataaaccatcaacagcaccaatgccaaaacgaaagaaatcacaccggcattgatagcctcttgtcccaaagacggaccaacgacgtcttcttgaacgatatgtacggaagcagccatcttacccgatttcaatacgttcgctaagtccttcgcctcttccggtgtaaagtgaccggtgatttgtgaacgacctcccgtgatctcatcgtttacgttcggagcggaataaaccatctcatccaaaacgatagcgatctggcgaccgatattctctttcgtcaaacgagcccaagccttagagccttcggcattcataaccatgttaaccatttgctctgaacgaccggcttgttgcataaagtcagcgttagcatctgttactacgtcaccacctaaagcgggacttccgtcacggttcgttaccttcaaggcatataactcaaagaactgctctttatcatcgatcgcctttacaccccattttaaagccaagttacgaggcaatacctctttcacttgtttcatgttcaggtattcgctgatcttctccatatcttttgcttgagcgatacctaccgtcgaacccggagacaactgaccgttgtactggctaatctgcaataaagcaaataatggatgttgcttagcgaactcttccatgctttgattagcttccgtatcttttttatcttgaccgagctcagccaacaaagaatcggcctcacttacattcgcatcagcggcatcagcgattttctcaacattatcggtagcaacagaatcagcggaagcctccttacttaggatagtagccaatacattatcagcggcaaccaattgttgatagatttccggcaacttataagtttcccagaattccaagttagcgctaccttgaagcaacttacgaacacgttccggttctttcacacccggcaactcaaccaagatacgacccgctgtctccaaacgttggatgttcggagaaaccacaccgaaacggtcgatacgagtacgcaatacgttgaatgagttatcaatcgcactctgcaactcttgtttcaaaacagaaacaacctgagcgtctgagctctggggcgtgattttatcttttaactcgaatgtactgaaaatagcggaaagacgtgcgccgctatccaacttcttatactcctcagcgaaaaggtcgatgaaatctttttggctagtcgcttgatgcgcataagctaaatccaacgccttgttgaaattctcgtcttggttgttgttagacaacgaacggattacatccgccacgttcaactcaaggacaacgttcataccgccctttaagtcaagacctaaactaatttccatttcacggcattgcttaagcgtatagcctaaccataccttctgagtagatagtgagtctaaataagcactctctttcgcaggatctccacccgcatactcagcggctttactgttgtaatgttgcgtcacgaacgagaacgacaaatagaacaaacagacaagcgtaagtaacaccgcgaagacctttacaaatcctttgttttgcatctgaatcttaggtttatgttattacattatttatattcgttttttcacagggtgcaaatatagactttttttctttgataaagagcaattagtataattatttgtcacgctcatagtttatttcaaacgcaaatgtatatctttggggctaaaataataaggaaaatataccatgaaacagttattattcgctctgttatttatccccgccctgctattcgcacaagaggatcaacactatctggcaggggccgttccggttgcagacggtaaagtcgtttttacccgagagattaatgccccctctttaagcaaggcacaaatctaccaacaactattaaaatggggacaagaaaattttaacacaaaggaaagtagagtagcttatcaaaatgaggcaaaaggcgagatcgccattatcggagaagaatatatagtattctccagcacagccttatccctcgatcgggcgatgatgaaataccgtattatcattgaatgtaaggaacatgcttgtaccctgcaacttgcgggcatccgatatgaatataacgtgtcttaccagaacgagccggagaaatacctagccgaggaatggatcacggacgagtatgccttgaataagagcaagacgaaattgaaccgtatcagcggtaagttccgtaaggccacgattgacttcgcggacaagacgttcgatagcgcaaccaacacattaggcgcacagttgctgacaaccgcaccgatagaaccagtatccgctccgcaacgggaaacacgagctgtggcaccgatggaaggtttcgtagcgttccaagctgacaaaatacctagcacgatcctccaaatgttaccggacaacgctttacaaatcaaagccgtaaaaggaaatacgaccgacgcaaacgttgaatggaaaggcataggcaatatgttcggtaaaacgatcagtacaatctccatatccaaagatagtcctgcttataaagcgattggcaataacgatgtatatcgattatccttctccaagcccggcacatctgccgatgcgccatggattattatcgagtgccgtaaacaaggcgagacctccgaaggacagcaaacgatgttaatcggcgagattacgaatgtatggatcaaataacgaaaaagagagttgcatttatgaaaaagattctattattaatatatatgatgttccctgtgctagtcatggcgcaggggcataaaggcgaggtagacgaatgcgcccccatgaaaaacgggaaggtatgctatagcgatgatgtagagatcgagaatacctctaaactagaaatattcaacgctattaacgcatgggctaagaaatcttatggaaaagatgtcttcttatccaacgtaaactcgaacaagaacaaagggaccatcttcgtaagctctaaggttgaattattgttgaatgatacagacaagactatcattaaatataaaatgcgtatcacctgcttcgacaaccggtacacgatcgaggcgagcgatatcgtatatcaatatgatccgctaaacgataaaaagtacaagacctataaagcggaagatgtaatcgccaataatggggatagcaatacgatagcgctgatcaaagatcctaagctattctgtaacgctaccttcttctttgtcgagaacttgttcgccgacgtatttgacgctgcgcagaacgcagaatccgagtgatgaaacccttttattcaagtttcaaataacaccataacgggtagtggtctgaataagcgaccttatccacggaacaattcatagaggtcatgttcggggaatgcaggatattatcgatacggaaccagaagaaattttgattataggtaatgcccattccccggccagactcggcaaaggcatccgtcaaatccccttggatcgtacggtgcgcataagaaataggcgtatcattaaagtcaccgcatactaagacataatctcctttcgcgttcttaatctcttttgataccgcttccgcttgcttagcccgaatccggaaagcaggtcctagcttttgctcgaacgctcctttcaaatcgtccaacccatccgagctaaagctctttataagggatgaataacgggtccgatcctccatcgtcagtttaaacgattccaaatggttattaatcaaggtcaacttctttcccttgatgttcacttcatgtacggaagagccgttataatccgaatcgtatttcaccatccgggaattcgacagcggatatttggagaacacagcgatgccgaaactctggaatttcgtggagctttgataaaatacagaacgataaggatacatgctcaacgcatcatagatcttagaggcagtaaggctcttctctgatttagccgtggcatattcctgcaaacaaacaatatccgcgtccgagttagcgatatattggataatcttgttcggagctatcttcgtatgattcttgtacccaaaagccatcacattataagtcagcaccttcagtacctcttcccgagggacatccttatgcgagtgaaacggaaaatagcgtttcacgggaccccaacataacaagaaggagaatatgccgatcaataagaacttccattcccataagaacagccaatagataataaagcaaagattgactacacataagactggaaaggctaatcccagataagataacgtcatactcgtctcaggagacacccgatccgagtaagccgagactatcaacaacacgacagccaccacattcgctacgacaaataagaattgaagaaaaatccgtagagttttcataagtatctgttatttcttactggcgtcgaaaagtcgctttttctcttcagcggaaaggctctcataaccggaacgtttcaatttatccagtatagtatctagatccaccgactcctgatgtttgcgtgcgttatactcataatccgtttcgttacgtttataagtcacacgcatcttcggtttccgtttgcccaaattcacgaaccagtcgatcaaccgattcatcggagcggtcaagtcctttccattacgaatacgggaagcgaaccacataccaaacaaagccccgccgatatgggcgatatgtcctcccgcattatcagaagtcatcgccaacaaatcgatcaccagcgtaaagatagccaaataaattaatttgatccttccgatcaagaataaattaatctccaaatccttccggtaaaacgacacggcgaaaacgatcgccataacagatgccgaagcccccatcaaatagctaaaagaagccacgttctggaaataagggaaaatattataagcaaggacaaacaataccgcaccggcaagacctcccaatatatacaagcctcccaactgccgctcactgaagaaattcaagaacaatcccccgaaccaatacaaccaaagcatattgaacaagatatgcaagaagtcaaaatgagtgaacatataagtaaacaacgtccacggacggaagagcaaaagttccggagaagccggtaactgcaaatactgcaaaaaaggtaccccttgcacattaaagagcataaacaatacgctggccaaacgtatcaagataaacaagcctacatttatatatatcagtttcgacaggatattacccgactgaaacatacgcttcaaattagtaaaaataccgtccattgtctgcatctttctttttccaataacgaattaggaaataaccgaataacataccccccaaatgagcgaaatgcgctaccgtatcgccaccaaaactagccacacccataaatagttcggcaagaccataaaatattacgaaatatttggctttaatcgggatcggtatgaacatcaagtacaaaggaacattcgggaagatcatcgcgaatgccaacaagattccgaatacggcacccgaagcgccaatggtcacgaaataattcaagaactcgcttttgctgataatctgggctccattcaagtttatcatgtcttggctagcgaagatcacatcccgcaaattaaagaaccataccacctcttgtaccaaaccggcgcctatacccgtcacgaagtaaaaaatcaagaaacgtttggggccccatacgttctccaatacccggccgaacatataaacggcgaacatattaaaaaacacatgcgcgaacgaatgggtatcgtgcatgaacatataagaaacgatctgataagccttgaagtcggtagcacccgggaagtgaagccctaataaatccaccaaatcgatgccgactttcggcagtgcaaggctggctacccaaaatagcaagtttataatgataagatttttcgttaccggcgggatactattcaagaatcccgaatttgtctgattcatcatatactacgttaatttagcggcaaaggtaaatatattttagccgtttttgcccataataatactaaaacatatgtaaatcggtaaaaaaagtaggtttttcttttgtgatatttcaaaataaaactacatttggagccgtctatcggttatcatagttttgtttaatatattaacagtcaaaccatcatgaacaaatcagaatttattagtgcagtcgctgaaaaatcaggtctcagcaaagtggatgctaaaaaggcagtagaagcttttgttgacacagtttctaacgaattaaaagaaggcggtaaagtcgctctacttggcttcggttcattctctgtgtcagagaaggccgctcgtaaaggtgttaacccgaaaactaaagaaaccattgaaatcgcagctcgcaaggccgtgaagttcaaggctggtgctgaattgaacgagctaatcaaataagaaacaccattattctctatagaagaaggatacgatgcaaattgtatcctttttttgtgtaccttcgcgtgcaaataaaatccgaattatagttagacgaatatggttatcgaacaacagattaccggagctatcatagccggcatcaaagagctgtacggagcggatgtcaccgctagccaagtgcagttacaaaaaacgaaaaaagaattcaaggggcacttgaccctagtcgtattcccattccttcgcatgtcgaagaaatctccggagcagaccgctcaggaaatcggtgagtacttgttgagaaacgagccagcggtagctgaattcaatgtaatcaaaggattccttaacctgacggtcgcttgctcttgctggatcgatttactgaactcgatcaatgagcagcccgcttacggtatcattccggttaccgagcagtcgcctttggttatgatcgaatattcttctcccaatacaaataaaccgcttcacttgggccatgtccgcaataacttattaggatacagcttatcgaagatcatgaaagcgaacggtaaccagatcgtaaagacgaatatcgtaaacgatcgtggtatccatatctgtaaatccatgttggcttggcagaaatggggaaatggagctaccccagagtctaccggaaaaaagggcgaccatctgatcggtgacttttacgtattattcagcaacaaattaaaagaggagacccatgcgttagaagcgaaaggccttaccaaggaagaagccgaggctcaatccaccttgatggcggaagcccgtgagatgcttcgtaaatgggaagccggagaccaagaggtgcgtgcgctttgggaaatgatgaataattgggtatacgccgggttcaacgagacttataagatgatgggcgtagatttcgataagatttattacgagtctcaaacgtatctggaaggaaaaggtaaggtgatggaaggcctagagaaagggattttctatcgccgtgaagacggctccgtatgggctgatttgacgaaagacgggctggatgagaaattattgcttcgtgcggatggaacttccgtctatatgacgcaggatatcggtaccgccaagctgcgcttcgacgattacccgatcaataagatgatctatgtggtagggaacgagcagaattatcacttccaagtattatcgatcttattggataagttaggcttcgagttcggcaaaggattggtccacttctcctacggaatggtagagctaccggaaggtaagatgaagagccgtgagggaacggtcgtagatgccgatgatttgatggccgagatgatcagtaccgcacgtgagatttcccaagaattagggaaattggacgagatgactccggaagaggctgagaatatcgcccgaatcgtaggtcttggctccttgaaatatttcatattaaaggtagaccctcgcaagaatatgacgttcaacccgaaagagtctatcgacttcaatgggaatacgggaccattcatccaatatacctacgcccgtatccgttccgtattgcgcaaagcggcggaacagggcatcgtattaccggagcagttaccgcttactttcgccatttccgagaaagaagagaacctgatccaaatgatcgccgattatgcggagatcgtgaaagaggcaggtaagctatacagcccggcctgtgtcgccaactatatttatgatctggtaaaggaatacaatcaattctatcacgatttctccatccttcgcgaagagaatccggaattgaagaacttccgtttagtcttatccgccaatgtagctaagatcgtgaaatccggtatggatttattaggcatcgaggttccggaaagaatgtaacgatagaagatgaacataaacgagaaaacaagaaaggctctccttcgatttcaacaaaatgaaatcacggagagccttctctatacgcaactcgccgctatcgagaaagatccaagcaacaaggaagtattactacagatagcgaatgacgagaaaggacattatacgatcctgaaaaagtatacggggcaagagatctccccgaataaattacgtgtcaccaaatactactggttggcacgtatcttggggattactttcgccattaagctaatggaaggtagcgaggaaagcgccaagaatgattacgcctcttatgatgagtatccggatttgcaacaaatcgcacgtgacgaggatgagcatgagcagaggttgatcgccttgatcaatgaggaacggttggaatatatgggttctgtcgtactggggctaaatgacgctttggtagaatttacaggtgctttagctggctttacccttgccttgagcgactctagattaatagctttgaccggaagcatcactggaatagccgccgcattatccatggcttcctccgaatatctatctaccaagtccgagaatggaaatgaaaacgggaaacatcccgtcaaggcatcgatctatacgggaatagcttatatctttacggtagtcgccttggtcgctccatttatctttatatcgaacgtattaatggctttagggcttatgctcatcatagcgttgagtatcatcgcccttttcaactattattattccatagcgagaagcgagagtttccggaagcgttttaccgagatggcagtacttagttttagcgtggccgcattaagcttcttgatcggatatgcgttaaaagaatttacgggcatcgatgtctaaaaaatcatagttatgttttgaaaaattcatagttatgagtttagtaaatcataactatgaatttttagagctataatcaagcctttttccgtgtcgtacgtttcttcgtcgcagcaggtttttctcccgcctcggcgattatcttctggcattcctccaaggtcaagttctctggtttctctatcgtcttagggattctgtaattctttttcttataagagatataagggccgaagcgaccattcaagatctccatttccggatcctcatcgaacttcttgataaatcgttgctcatctttttgtttttttgcctcgatcaactcgatagcttcctcggctgttatcgacaaaggattcaagcccttcggtatggatacgaactttccgtcatgacggataaacgggccaaaacgtccgacagcggcaaccatgaccttaccttcatattcaccaatcgtacggggtagatcaaacaatttcaaggcttcttccaaagtaatcgtctcgatagactgccccttcatcaaggttgcgaactgaggtttaggagcctctttatcctctgggtgcgcctgcccgatctgtacgactgggccataacgaccgatcttcacgaaaacaggtttgccgctcttcggatcgatacccaattcacgctcacccactttatgctccgtacggacagaggctgcctcttccacgatcggatggaatagtttatagaatttatcgatcgcatccgtccataccatctcgccttccgctacggcatcgaattccttctccacgctcgccgtgaagttataatccataacgcctgggaaatactccatcaagaaatcattcacgaccgtaccgatatcggttggcatcaacttattccggtccgcccctacgatctccgtcttttggacttccttgatcgtatgctgagccaaggttatgatattataagtacgctccgttccttccttatcccctttcacgacatactctcgattctgaatcgtctggatcgtaggcgcataggtagaaggacgaccgattcccaattcctccaaacggcgaaccaaacttgcttccgtatagcggggaggacgttgcgtgaaacgttcggtagcgactatatccttcatactcaatacctcgttcaaggtaaccggaggaagaaggccgttttcctgttccttctcattctcgtcatcaaaactctcgcggtacacctgaaggaaaccgtcgaaagtaatgacctcaccggtagccacgaacttctctttcttgccgccgatgcctacggagatcgtcgtacgctccaactcggcgtccgccatctggcaagcgatcgtacgtttgcggatcaattcgtataatctcttttcctgagcggtcccgcttatctcatcattgctgatataggtcggacgaatcgcctcgtgcgcttcttgcgctcccttgctcttggtatgatattgacggaatttataatatttctcaccgtaggtatccaagatagcttcttttgccgtccccaaagccaaatcacttaagttcacggagtcagtacgcatatacgtgatcaatccggactcatacaggcgttgggcgatcatcatggtctgcgagaccgaataacccaacttacgggcggcctcctgctgcaaggtagatgtcgtaaaaggaggggctggtgttttacgcaccggctttttcgagatatcatcgatcgtgaaagaagcgtccttgcaagattcaaggaatgcctccacctcttccttatctttcaaacgacggttcagctccgccttgaggattgtcgtaccatccggcaagataaagctagcgatcacacggtaggcggcctccgagacaaactcgttgatctctcgctcccgctctacgatcagacgtacggcaaccgattgcacgcgccctgcggataaagccggcttcaccttacgccaaagaatgggggatagctcgaaacccacgatacggtctaagatacgacgggcttgctgcgcgttcaccaaatcgatattgatatctctcggcgtctcgatcgcatgtaatatagcgttcttggtaatttcatgaaaaacgatacgtttcgtattctcaggtttcaatcctaatacctcatataaatgccaagagatggcctctccctcccggtcctcatcggaagccaaccaaacctgctcggctttcttggcttcgttcttcaattcggtcacgagtttcttcttatcagagggaatcacgtattccggggcataattgtgttcgaggtctatactgaaatctttcgttttcaagtcgcggatatgaccatagctagacataaccttatagtcctttccgaggaacttctcgatggtttttgccttggcgggtgactccactattaccaaattcttttgcatatctattttttgctggttagaaatcgggtgcaaacttacacaaataattaacgtacgcagtatatcgatcactaaaaaagcgttttttcctatacattatatatatagtcatgcgtttctatttaccttcgcgggacaaaatcaaaaagctattcaaaaatatggaagagataaagcgacttatttcagagaataaactagaagaagcgatccggctcttggacgcttacctcacggagcaaccgagatccgacgaggcttggtttctcctcggaaaagctcattataaactaggcaacgtacgcctagccctcaacagctacctgcaagcgatagagatcaatccggaaagcccggcacaagcggcctacgatatggcgatcaaggtgctggatttttataataaggatatgtacaaccattaagaagatgatgaacggcccccgccgccggagtcggaacggtatcgaagcacatggcgaccctagccgcataaccccaaagctaagcgaaacgcacggcgacccccgccgcacgactccaaagcaaagcgaaacgtatggcgcccctcgccccccacttcgctaccgttccgactccggcggcgactattatttaccaaataagcatagtatccaaattaattcctacctttagccactgaggacaaacaataagttaaaccttaaataaaaaaaaatgggaacatacacgaaaatcaaacccgcgggcctgactaaattgaacaacgcagagtacacaaacttcatgaacgccttctaccggctggcgttcgctgccggagggggaggtggtgactccgaaagccccgacgagatcagtctggacaataacccgctaggcatcaccgacgcgcaaaagacggccttcgagaaggagctgcccctaatgaccgacctcgtgaaccaatcccacatcagcgacgagaccgcccagttgctagacttggacaaacaacgcgacgacctcgtggtctatctcaccacctcggtgtcgcaaatgaggaaaagccccatcgaggcgcaacgcacggcggcacagactgtctacaatattatcaaaccctatatcggcatctataaatcggccaaccagcaagagacggcgcagatacagggtcttttgctagatctcgacaaggagggggttccggcgctgatacagacattggggctgaaagagatactagatagcctccgtgcggcgaacgacgaatacgcgaaactgaccgcccagcgcaccggcaacagggcagcctccatcaaagaggcgagcgcggtcgtacgcctacgtatggacgacctttacgatgatatgaccacgatcgccttcgtgcagagcgtagcggctcccaccgccgagaccgcccgcttcgtcaacgagctgaacgcccttatcgacgagaccaccgccctctacaaccagcgcgtcggcgcggcgaaggcggcagccaagaggaaagaataaactccatttatgtaaaaggctataagattaatcttttaaattaaatcatcatgaaaaaaacattattaaccttcacattattagcaggcttatcttcatgtactaacttatcggaagatttggacatgatcggtacgcaaaatattactcaaacaaaatccgggaatttatccataagcgaaaatgaacctgcaattgtcaaagatttaagaaattatatttcccaaattaaacttcaaggaaagcaggcccgtgtcctgacaagttatacattgactccttacatatacaaagaggatactatcatgtatattgctaattacgaggatggttgggagacacatcaattaggaatcaactggggatacgatggctcgtatgattatttatggctcgaggctagctcctatagcgattgggtatcaaataccacttatgacacagaacgttatatgttaaaataatccttttaattatgaatacatcactatttaaatacctcatgctatctatgttctccttggtctttttctgtacatgcgataaagacgatgaactgagtggagaagaatttcgagtaacaatggaaaaccgattcttctcaataaagacatccaagacatttacaaagaaagatggctcgacagaaataatgcaagaagggaaatcctatcttgctgattcgccctcaactatttggttccatgacagtaagctatatattccaatacagataagtagcaaagacactctatggcagaaatggaacgcttatcaacgagagaaaggactagggaacatactattacttgtcggacataaatacatgtatgaatctcaaggaaatggattaatcacccccgatcagctattggtacatgagcagctaggtggtcgtttttatttaaaaacggatggagacaatctattacacgcaacgatcctttatccggatgatatcgctgacgatgatacaatcttcccaaaaagtgagttctattatcaagaagagctatcacctgataaaaacgtcagcttagaatatcatgtttacgactcagacgaggaagcaatagcctatatcatagaacaaatgaaggactggaagccttccgaatgatgctaatcagcctctcatccgatgatcagaacaaaaagagccgtgtcattactcaagaatagagtttgacacggctctcttttaaatttagtagttacaatcagtaacatttccgaatagtcacttctaaatccgtcacaccctcgttctcataaaatctgccctttataagtcagcgccaacatcgtaatatcatcgctctgcgtagcgccgttcacgaatgattggacggattcggatataccttcgatcatggctttgggagattggttcttcacggagctacaagcctctaccaaacggatatctccatattgctcgttccgcaggttcatcgcctcactgattccatccgtatagaggaacaagctgtctcccgcttccagtttcaaggattgttctttataagctaatcccggcacgactcccaaggccatcccaccagtcattggcaaaagagataccttatcgttcttacgaatccaaaccggacggttgtgcccgccattgcaatacaccacgtcgcccgtatggatattcaagatcgcgtaaaaagtagtgacaaacatcccgttgacactctcacggcacaatagatcattcgattccttcatgcagaccgccggggaaagctgcctaagcgccgtagcacggatcaccgtacggctgatcgccatgaaaatagcggcgggaatccctttatccgacacgtcggcgatcgtaaagcccagatgattatcgtccaccaagaagaaatcatagaaatcaccccccacggccttcgccgcgctcatggtcgcatagagatcgaattgcttatattgcgggaacggagggaactgcttcggcaagatcgattgctgtatctcacgtgccacgttcaaatcgtattgtatctcctctagctgatgatgttccttttgggcctccttgataaaagagatctgctcgaccgccttctcgatcgtacgttccagatcctccatatcgatcggcttggtagcgaagtcgaaagcaccatggttcatggcggtacgaatattctccatatccccgtaagccgatacgatgatacatttcaaggccgggttacgcatctcgttaatcttcgtcagcaatgtcaagccatccatctccggcatattgatatcgctcaatatgatatcaaagtccggatggtccaacatcatcctcaacgcctccaaaccgttatgggcaaaggagaactcatactctcccttacggatcttccgacggaaatattgggttagcaacgcttccagatcctgttcgtcgtctacgcttaatatcttgatcgccataattcttctgtttatttcgttaatggaataaggaatatgaaacgggtaaactcaccttctttcgattccacctctatcttcccgtcatgcttctcctctataatggatcgagtgatagatagccccaagccagttccctctcccaccggtttcgtggtgaaaaacgcggagaatatctgctcccggatatcctccggcataccgataccattatcctcgatacttaatcttaaagaatctccctccttccgtagatccacggatataaccggctcatacccgatcggcgagagcttggatttactatagaccgcatagcaagcgttattcatgacattcaataccgcacggctcaaatcctgcgggatcactttcagcatcggaagtccctcctcgtaatgctcccggatcgcaatattgaaacctttatagttcgctcgcatcgaatgataagccagccaaacatattccttcaccagattcttgatatccgtagggatgtactcgtcatccttccctctggaataaagcaagataccccggatgatacttgtcgcccggtttccatgttcctcgatcttcttcaagttaccatgcaaatcgttaacgatctcgctaaactcctcatgcaaggcggtcagcttctcccaagattccggaggcaagacatctttctcttcttctaatatatcttccaagtcatccactaacttagaggacagcttactgaaattgatgacaaagttgagcggattctggatctcatgtgcgatcccggcactcaacatacctaaagaagataatttctctaagttcttcacttgcaaacgtagccgttctatttccttactctggtcttccatatctattcctcctctttaggcggtgtaattgttttcggttgatatacagggatcgtaattagaaactgggtatattctcctttcttactctccacctcgatggttccccgatggttttgcacgatctcacggcataggtaaagccctacgccagccgcttcccccgttgtctttgtcgtgaagaaaggagcgaatatcttatcttttatattctcgtcaataccggacccgttatcccggatcgttatttccagcatatccttattgaccttcaatccaaggaatatctccggactaaaagtcacggtctccgatttcttcaacagggcatacatggaatttttcaatatcccggccagaaccttactgaactgctccacgtttacctccatcatcaaagacagcgtcaaattatcgaaaataatccggatattcttctcttgaatatcctgctcatacgttttcttcaatttatccaaggcgatccggcataatccgtttatgttggtaagcgtaagattacctcttcggtctttcagcaattcctccatcgccttaacgatacggaccgtattgaaaccatgctcggagatcttctccaaattactggtcatcatattcaacaaatcaaccgagtcgtcatacacatccggtttcagatgctctttctgactatccagattttcccggagatccttggccagccccgatgtcaaattcgcaaagttattgatataattcagagggttcaaaatgcggtccaccaaaccttgagtcaattgtcctacggtagccatccgttccttacggaccagctcgtcctgcgcctcacccaaggctttcaaagcggccgccaatttctcggattcctcttggatcgcgtctttctccgaacggatctcctgcgtacgctcctctacctcttttaccaaatactctttttgtttgagtttccgcttgaaaaccaacttagagatctggcaaaacagaatcaagaaaagcaatccgatccattcttgatgaccgaacttcacagatacacaaataccgaccaagctacccagcgtaacccgctcgcaaagtttaatccgcctttttaaccgatcgatctcggtatgtaaatcctgtatcatgatgaacctcctttcctaactataaataggcaacgtaatcgtaacttccgtatatttatctttctccgactcgatagcgatcgtacccttatggttcaacacgacctcccgactcaagtaaagacctgttcctgccgcttccgcggtcggtttggtggtaaagaacggagaaaagactttcgtctttatcgtttcttctataccgacgccattatcacggataaccacttgcaacttatccgcttgaatacgcaataccaacgagacagaaggctgatatcccggttccccgagctttttcaagaccgcatatatactattatccaatatctgcaacaaggcttttcccatctgatcgatattcacctcgattgtcaacggtacggaaagcccggagaatgatagatctacttgattcttctcgatctccttcgcataattctttcgcaagatatccagattgaccttacataaatcattaatatccacgcaggttcgattcgccgaatgatctttcagcaattcttccatcgcttttacgatccgcaccgtgttatcaccatgcttggctatcttatccagattgccagtcaaaagaaccagcagttcttgcgtatcattataattatcgtgtttaccggtctcttcgtcctcatcgatattctgcttgatatctttcgctaatgcagcagacaaatgagcgaagttattgatataattcaagggattcaagatacggtctaccagacctttcgttaattggccgatcgatgccagacgttccttacgaaccaactcgtcttgagcgtccgccaaggcagaaagggcacgggatagtttctccgactccgcttgcatcgcatcccgctggaaacgcaattccatcgtccgctgttcaacgagattagagacgaactgtctttttcgcagacggaattgcgtataatactttaacaggaatagaaggactacggctcccaccaaataataaaccagttcttccttcttctggtaaaccgccaaggcgatccacgccgtcccgatcacggtcagcgtctcgatcacccgcatcctccagcgaaggctttccagttgtttgatatttatgtcgcccatccttcctgtcctccggatatcagaaattgatattcacgcccaacatcgcattaaaactctgcatcggataaccgtaatacagttcgtacttctggcaaagaatattggtcaacttggcataaacaccaaaggtatcgttgaagatataggtacctgttaggtttagctcgttgatgttatccatcttaaactcattcattttatcgtacgtcataccagtgttcccattgacaccccaagtccgtacattcgcataacgtccggtagccaaataataatccaaagcgatagataatttctcaatcgggcggacggtcaggttcgcattcagttccatttccggcttcccccacgcatgaggcaactcgccttcatccgtttccgctttccaattattatatacacctttcaaagcaatatcgaaccattgttgataactatacttcaagttggctcccacgaaaagttgcttcgtgtcgatacccggctccgcaacactgaaactgccgaaataattcgctgaccaaacatcagactgagtaaacagcacatcatcgctcgttatcttatatccggcgaacacatcaaaccaaaagcccggtgccacgccgctccggatacccaagacagcgtccagccaattgcgcgagggcaatagttctgccatcgggtagaggtagcggttcacacgcgacatctcgtacatgctgttggagtacatcttgccgccagcgttcacgtatagctccgtcttgtcggccacctccacatcggcggctacattcggagaggccatgaattttgtctcgtcgcccgtagccagcatcacgttcgcacccagctttaaattccaattatcaccctctaccttataataaggcgacaacatcgcctcgacatggttcttgaactcatattcataacctcctacctccggcaaactgtaattgaaatattcgaccaaaccgcccaagcctactcgcatattcccattgaaaccagcgttcagatcaaactttgcctctagagtatgctccgtagggccgtccatcaccctacttaatccatatttatgcgagaaattagtataacctaagtccaacaaatagccaacctcagcctcctccttcgactcgaaacctatcgtagcagcgatcgtctggttcacttggttggtttcgcgatctctctgtaacaaatcctccgaaggggcataactggatgtaggatcagacaatgccgccccataataattgaatgcggagtagccgtacttcgctccgatactgaatatcgtcttctcgaaagcgtgcttgtagttgatgcctcccaagttgtcattgattttcgccttgacatcataatcctttggctttccgttcgtggagcgatgcgaataccatagattcagctgatccttctcagtactcaggatatgatagcccaagtctccgttgatattcatgcgcgtacccataccaaagttaaaatatccccgacgcttgttgtaatccatctgcgtcatgatatttccggaaggcaacaaactaatctctttctgcggatcggcggcgatcgtataattcgagtaatcgatcgggatcttacgaacctccggctctttcaccacgggaagcgtatttaccttgctagcgtcctgcacggaaggatcatactcccgttcaagcgtcatctctcggttcaggttcttttctttcgtaacatcctcttgcgcactcgcagcagcagccgaacccagcaaagctaccacacacaacgcctttacattatatatagtcttcatcgctttcttttatttctttagtttacccaatctgtcttcgatcatcgcggcgatctcatcatcgcccttgtagttgttttgcaaactggtcagatattgacgagcttggaaatcatcaccttggcggatataaatatcagccaacaagataaagccccgtgccaaccaatattggtgaggcgtaccgttctcgatgaagttcatcaagacagtctcggcattcttatcatccttattatcataatacaattgagccaatagatatttagcctccgccccgtgtatcgtacgggtatccttgctgatctccttcaagtcggccaacgccttgttctcctgcttcaagctgatataagccttcgcacggacataacgggcctcggacataatctcgggagatagcttcggttccttcagcaaatcgttggcggcaagcaaagcctcttgcggctgaccggtcaactcggcgcaacgcatcaagcccaatttagcggcctccttattctccggattctccgctaccgcctgtagatgcttgaaactttccatagcggcggcgtaatccttatccagatactcgatctcagccttacgagcccaagactcttccctgaatttcgtatcaccgctctccaataccaacgagaacagacgtttcgcctcctccagatctttcttggcaaaagcgatacttgccaaatagaaattagcgttcgagctaaacgctccctgcgggaaggtttgcaaataattcgtcaagctacgacgagcgccctcattatcgcctcgcataaataacttctcggccgccagataggtcaaggagtcttgctcactcacctcgaaacgaacatttccacctaacgaattcgcataggcggcaaacgaattgatatcgttcagctcgatatatacggacttcaaatcttgcaaggccactttcgcctcctcgctacccggataattgctaatcacgctcttataagcgtcggccgctttctccggctgattgtcgttgaagtaaatcaaaccaagctgtacgccggccttacgagccagactgctttgcgggaaatcacgcatcaattgctcaaagcttgccgcagccgtttgattgttatccaataacacgtaagaacgtcctttctcgaacaaggcatcatccacatattgtgattccgggaactcacggatcaagcgatccatcacgctgatctttcccttataatctttctgcaatcccagcaagaagcccttctgatacaccgaataatctccggcggacggttgcaattgcgccgcacgggtataattctcttccgccatagcgaactgacggttgtggaataaacaatcgccgatacgattataagcgtccgcataagccggagtctgctgattgctttccaaattcacgtattgacggaaacggttcaacgcctcgccatactctttcaatttgaagtagctgtaacctaagttataatgtgccaaggcatacatatccgtattacgttggcgggtattattcaaataggtacgataatcggaaatcgccttgttatactcaccttggcgataataagattccccacgccagaaataagcgtcgttacgagattccagattataagcgcccaacgagatcgcacggctgaaaagatcgaccgccttatccaattccatattcgtgaacgcctgcgttcccaactggaataagatatcttgcttcgcctccaagatcttcgtgctcggatgcttgatcttatcgatagagttcagagccgcttgatagttcttggtagtcaaataaacctccaccagataatcgtttaccttatcggcatatttggaattcggaaaatcattcaagaaatcctcgaagattgtcaccgactcgccaaagcccgtgaaagcggtctcgtggatcaataaagcgtaattatacatagccgcctctttcacttgcttatcgaaagaagaagtcgcggcagcctcgaaggccatacgggcgttattcttatcttttaatttcagataactttgccccagatacagataagcgttctgcgaaagggcatcgttctcacgtacggtccgccccaaagcgttcacggcgctactgtaattacccttattgtaataacatacgcccaagatatataaatcgcccctcaacgggctatccgtcgaggatacatatttactcagcatattaatcgcctgatcctcatttcccagatgatagtaggcgttacccatgatacggtaaacctcgctattgttctcgctatccggataagaggctagcaattccttaccttcgctgatcactttctcgtatttattctggataaaataaatttgcgtgatatagtacaaggatcgctctttataatcaggcaagtccttcaagcgggtaaattccaccaaggcattgttgtatttaccggttgcgtaatcgatataagcgacataataggtagacgcttcccggtacttcgttccaatctgctcgatccgtgcgaaataaccacgggccttctccatatccccgatttgcaacaaggaataagccagacggaaacaataagcctcctgttgttccggacttagcatatcaatgttcgattcgttaaaccaaaagatagctttctgatactctccctgtccgaaatgggcggaaccgatcaagaagttcacctcgtccgcatgacgggaagccgggtacacatccagataatctttcaataactcaacggcattgggacggccttgctcataagcggagtagaccaacatataatcggcttcttgaatcaagtcggcatccgtggaatgctgtttatacgcctccagcttatcgatgcaacctgaataattcttcaaactaaacaactccttgccttcgacaaacaaacggttcggcgcatcaaattgatacgatctctgcccgcttgccatgtggctgcctactaccagacacagcggaataagtattcttttcatcactcatttgctttttaatacaagcacttacttcagtgcctattcgttctaattcgcaaatataagtaatatgcgccaaacagaaggcaagttctattaatatttaggacaacacgttctaaaattatctctatggaagatgatacaccttatagggagaagatgtattatcttacaacgacaagatgtatcatgttgcaacgataagatatatcatctttcattttcgtacaattttcctaattgttattttctaagataggctggtaccgcctttcggatagagtctaaaccgaagtcttccggattcacattctccgggcgaaggatcacgatctcggcggcatcatcttccgcatgcacgttattgaaatcatctaccaagcactcataaaacatatccagcgtatgcacctcaaagccggaatacatatataaattaggcaaggaaaacaaataacggcaattctggatatgcaaccccgtctcctcccttacttcccggcgagcggcctcctcccccgactcaaacatatcgacgaagccaccgggcaaatccaatgtacctttagccggctcttttcctcggcgaaccagcaataactcccccttagcgttctttatgaaacaagcgacagccgacgacgggttgaaataataaacaaaaccgcacgccatacattttttcgctttctcgttatgttccacgaaagcttttgccccgcaaaccgggcaaaactgaaattgatacaacggatgtctcatactttatgatttataattcaattaaaaacaacaagccgcacctaaatatagatgcggcttgccttatttcgcaaatgtcttttcgttatacgtaaaaccggatttagacttccaaaccagcgctttggtctcttacttcccaacccaaagcacttgctcctaatacggcagcgtcgctctctttcaattgagagaataataatttagtcttacctgcgtaaaccttcaacatatttttctccattgaacgtttaatcgggttcatgatcaaatcgccagctttcgtaagaccgccaaacaaaatgatagcctccgggctagagaatgctacgaaatcagcgaaagcctctcccaacatagagccggtagcctcgaaaatctcaagagcgatcttatcattcttcatagctgcgtcgtatacgtcttttgaagtgatttcatccggatccaagtcgcgaagaacactctcgtccttacggatttccagatattcacgagccgtacgagccacaccggtagctgaagcataagcctccagacatccttggcgaccgcaaccacactgacgaccgttgttacgacgcatgataacgtggcccaactcaccggcaaaaccgtcatgtccgtataccaagttaccaccgattacgataccgctacccacgccagtacccaaagtgatcacgataaaatctttcataccgcgagcggctccataagtcatctcaccgatagcggcagcgttggcgtcgtttgttaaagcaacaggaataccatcgatctgttcgctgatcaattgagccaaaggaatcttacctttccaaggcaagttcggagcgaattcgatacatccgttgaaaaagtttccgttcggagcacctacacccacacctttaatcttatccggaccaccagcctgatcaataacagacttcagacctttagctaattccgctacatagtcattaacgtctgcatatttaccagtcttaattgatccactatacaagattgttcctcttgcgtcaactacaccaaaaacagtgttggtaccacctatatcgatacctactacataaggcttctccatgattttatatttaggattaataatgattttcctctttctaggtagcaaatataagaggtttaacacaagttgcaatacgatttgaagaaaattttacagattcctgtcattttatcttcttttttcgaaaacttatgttaagcaacattgttatataataatggagaattatcgcaacggtaatatctcgatccaatagtcatccggatcattaataaaatacaatcccatcttggtattctcgaagcaaaccgctcccatttccttgtggtatttacgtacctcctcataatcgccggctacccggaaacaaagatggctctcattgtcgcctagctcataaggttctttccggtcacgcagccaagtcagctccatcaagaaaccggtttgctcatccgttagataaaccaagataaacgaaccgtcttccgctaccttacgatggtgctctttcaatcccaacgctttattataaaaagcgatactcttatccaaatccaatacattaatattgaaatggtcaaatctacctttaacttccatacctaataaatttatgcgtttaaaataacctatacattaataatatattatatatccgtcccttctcccggaacagacaatacgatataacgacatcctttcgattcggcgtaagggccgaaagccataacctccgccggacgttcccaaaagtgcatcgggacaaatacgcttgtttttatacgatcgataaattgctgggcgcccctcatgaaatcggtacccaaacgaggatcgaccgggaacatgacgagatccatcacagaggtttctttcgctattatatccagttccttcaagtaattaccctcagcctcggctacctcttgcggggtggactcgtctttccaatgccaattattcaagtcgccggcatggaagatccgtctgccttctgtctctatcaggaaagagatccccacatccgtggaaccaaatgccttgatggtcagaagttcatcttgataggcatcccccttcttcaaataaatagcatcatcagccttggccctccgacgcttcaatatatccttggaaaagatatatttgatatccggcttctgctctttccatttcaatacttccggatgaaaatgatccggatgaaaatgcgacgctaatatatataatgtgcccgcacgcttcaagagttcgctacgcacgtatcccttggccgggtccggatcgctatccttgaaataatcgatcaagatcgaaaagccatccgcttccaaagcgaatccgctatgataaatatacaccaatctcataatgatcctcatttattgtttatcttaagaacaccgaacctcaccgggttgttgaattcacggtacaaatatacaaaaggccggacatatcacatgcccggcccacaatgattatcaacttacaatttatttccagttctcattctggactaatacgccttccatggtgacaatttcatcgttagggatcggaagtgtcactaatctatccggatacgtagccgattggtacttcagcaaatatctcttttcataagccaagaagcccgaacctttattacccagctcctcagaagccgcattccagcgcacaagatcataccaatgatgcccctccatcgccaactcgatcctacgctcgaaacgcaaggcttttatcgccttatccactgtccagccactcgcaggatacaagccgatgcgataattagccgccgtattagcaatggtatttccgctcaccttatcctccaatacatatggagaagaagttaaagccatattgttattcgcgtcggcagccatgatacaactttgtgcggcacgtgcgcgaactttgttgatatattctctggcagtattgatatcacccgtttctatacaagcctcagcataaagcaggtaaagctcagctacacgcatcaagtggaagttcttggcagttgagccaccggttgtagtcaagctcaagcctcccttatccgcctttttcggcaggttcttcttattcaagaacggaccgccattcgccaaatcacgaatccagccatcgatagtaactggtatatcccaatccatatagggcacattgaaacgacccgcagatacatcaacccgaggatccgtataaaccgtcaaatccgtatgaggtacattatcgccatcaattgtcgtaaccgaggttttgctttgatacgacttatcgagataaggcaatccattctcatccaccatatgcgcattcaccaagtcataagaaggctggtagaatccccagccggaaccaatcttgccagacaatgagatatgagagttaccattgatcgcgttggtataatactgcgtaccggagattgccatctggacgtcaaacacagactcgcccgtccagtcgctctcgcccgccgtgtaaagcgtctcataactcggggtcaaggtatatttcgtgcccttgctatccgtaccattagcgataaccgtttctaaaatcgatttagcctccgtccatttgttggaggttccattcgttccattatagggagaagactggaatattctcagtttcgccaaaaacgctccagccgcccatttgttggcacgaccgggctcttccggccatgcgccgggaagattatcataagcatactgcaaatcttcagccacctgttcccaaatataaatatagttaccgctctcatccacattcgatatcagtgggttcacggacgactcataatcctccaaagatacataaggaatagccgccccaaaattcttgataccctcaaacaaataaaaaccacgcatgaaacgagcttgggctatggcctcggtataaaaatctttctcctgtcccggtatagcggaaagctcatctttaatcaaaccggccaaatgcatgacattattagcacgagccaccgcatcgtatactgccacccatttacgcttgatataggaattatcggtcgtaaagctaaaagtctccaacaacgtgaagtccgattggtccgcagccgttgaccccttattagcgtcaccgcccatcacatcaccatacgtatagtttgtcaagcttgccccaaaataagagttagtcgtagccgccggaatatttaacgctgaatacatgccggtaagaagataattaataccttcctgatccgttaaattggtttcattaaccgcacctactggttcgatctccaagaaatcggaacaagatgtgctgcctaacgcaagaaccaccgccatcgcaaaatatataagaacttttttcataatgaattcaaattaatcgtttataaagcacatacgttagaatgtcacattcacacccatcaagaactgacgaggcataccataagatccataatcgatacctttattcatatcgcttgatacatattcgttctcgaacgaagtatgcgaacgaacctccggatccaatccatcataaccggttatcgtaaacacgttactgatctggccgtatacacgtatcttctcgaaaccgatcttcttcagcaacttcttaggcaatgaataccccaaagtcaacgtctgcatccgaagataagaaccatcttgcacataattggagttcgattcgttaccagcctcggggccctcggtcgaggtcgttgtccacaaaggataaataccgttcggattattcaccggatcccaagatttcgccaaacgatctttcgaataattagactgcaagtttccaaacatcgtatagtactcgtagtgtttgtacaaatcatttccaatcgagtaatacatgtaagtacttagatcaaaatctctccaagtcaaagagatattgaaacctccggtcaaatcaggatgaggattaccgataatcgtacggtcatccgcatcgatcttaccatcgttgttcacgtctttcatcttatatcggcctacccatgcggaagcgaccaaatcgttttccgtagccacaccataaggcagaacgcccgaggaaataacatcttgctcattttgataaataccatcaatctgatacccgtagaacattccgacaggttggcccaccgtagtaatattcaccttgctcaaacgagtatcattgaacaaatcagaagatcccaaccgggtaacctcattcttgtatcttgagatgttagccgtgatgttataaccgaactcgccaactttgtccctccatccaatggacaaatcaatacctctgttcttcatatcaccgatattgatactaggctttgatgcgttaccaaccagcgcagaccagttagcaggcacaagcaagtctgaggtattctttacataaaagtcaaatccggcggtcaatcggttactcaaagccgtaaggtcgaaacctatattaaacatttttgtggtttcccatttagcgtccgagtcacccaagttcgagagcacataaccgggagaagtctctgaatccgatcccgtgataggatacatataataatttcccgtaccatactggaacgcatagttgtaagaaccaatattcgaattaccggtcgtaccataaccggcacgcagcttaaagtcatccaaccatttccgggtaggctccataaatttctcgtcagacatacgccatcccaaggaggcggaagggaagttaccccaacggttcttggaaccaaacttggaagaagcgtcgcggcgaatcgtgaatgtcgccaaatatttacccttataagaatagtccgcacgtccgaaaaggccgaacatagtcacttttctttgataacggctagagttacctatattagaagaagaaccattatccagcgtccaagtattcggatcgctctcgaagatgtaatcgatacgggttccttgcatataacggccgacaccttgtttgatagcctccgtacccaaaacaacggtaatattatgatcttcatgaatcttcttggtataagtagccgtatttgtccactgccagttcaaacgccagttgcccgtctcagtcaatgtattgttggcagaagcctctttgttcgccatattttgacgttcggtcatctccaaactccacataccattcaagcgagcgctaaactgagaacgaagcttcagaccttcgatccaaggattggaaagctcggcaaaaaccgcagtctgtccatgaaacatgcgtgtccaatcattctcattcatagctacctgatgcacggcggaaatatcacggcccgcattaggtgccacggatcccgtataatcacctcctacattatatataggtacccacgaattcatggtataagtcttagcgaacgtgttcgcgtctccttgacgaccagactctcctcccgtttccatagcggcaaggttcgtattttggcccatcgtgaaatacttattaggattataggtcgtattcgtacgtaaagagtaacgtttgaaataagaattctggatcgtaccctctcgatttgtataacccaaagagacagaataagtagctttctcgccaccacccaccaaagagatctggtgatcttggatctttccggtctgtacaatctcatcgtaccaattggtacccttacgagcctccgcatcggaataaccgtcggccaacatctgataatatgcggatcgggcccaagagctgcttccatcgtctacatacgacttttcccaagcctctacgctcccatacatatcaataatctgctgttcgctataaccggccggcttaatcgcataaggcatcgaaatacctttaccacccgtagcggcgatttgcccgaattgaggatgagaggttgccaaaccacgatagttatacagattctgctgtcctaattcctcgaattccatcgattcccaaccgttcaacaaatcataaccgctgttagccatcttagcgacaccaaaatatccattataagagacacgaacacgatcagcacgcgtaccctgcttcgtcgtaatgataattacgccattcgcaccttgtgcaccataaatagcggtagctgaagcatccttcaacacttgcatagactcaatatcattcgggtttacggaactgatatccaccccggatacaccatccacaacaatcaacgggtctgaactattaagagaacccacaccacgaatacggatcgtagtctcaccgctgggacctccggaattagagatatacacaccggatgcttttccttgcaaagcctcggcgaaagtcgccaccggagtctcgtggatagcgtctgtagaaacaacagcaacagaaccggtaatgtccttcttcgattgcgtaccatatccaactactaccacttcatccaaagcttgagtatcttccaccaattgaatcctcacattcgtctgactactttttaaaggaatttcttgactgacatagccaatgtaagacacaactaaaatcgcattactaggcacaccttctaaaataacacgtccgtccatatcggagatatttccgatagtggttcctttaacaaggacatttgcccctacaattggtccggctttgtctgaaatagcacaaatgactctacgtccatcttgttgtaggctacgagttcctacgtttggtgttaaatcgccaacttccgcagcgatgatgggatatccgccgcaaaggaataaagaggctcccagaaacacctgtctccaaaatactacattactcataaaattagaatttaaggtataaatcaaaaaacacaatctacttaacaatttgattttttcatatagacacaacatcacagcttgtagctattactcatctataatacttatggtctaaatgttttttcataaaacgactagttgaaacgatcgtttaaatcttgcgttttcgagaagggggaaagaggatttgaaaaagaagagcttttttgtgggaagaaaaggttatctttcccattagcaataagataaaataaaaaaaaatgaacaaaaagttgcatgtgtcaaaaaaaagacatatctttacaaacgactaaatgaaacgatcgtttcaactagtcgttttttttaatatcatgaaaaaaacaagaagtgattttcataattaaaaccatgataatgaagaagctacacaaaagaagttgaaaagaagagagtgatgtttacttattttaagatgtaaacagatgtaatataccttagaggtatgagagagtagtgaattcattttgttaaaagtttgtgttttttattttattataccttaaattctaaatttgtatgagaaatgttgtatcatggaagccattagtcttaggagcttcttttcttctgtacggagccggaacggcctttgcaacagaaacagatcatctgtatcctacacctagtacgggatttatgagtgtccagcaagatggacgacagattaactgccacatcgtggataaatctggtcctatcgttggagccaacgtagtcgtaaaaggaactactatcggaaatatttctgatatggatggacgagccattatagagaatgtgcccgcaaacgccatcttagtagtctcttatatcggatacgtaactcaagaggttactttgaagagtaatcagacaaacatcaagatcacgctggtcgaggattcacaagctttggatgaagtcgtcgttactggttatagtacacaagcgaagaaggatattaccggatctgtggctgttgtcgctacggatgagttaaaagagactcctgtttccaatttcgctgaggctttgcaaggaaaagctgctggtgtatttgtacaagcaggtggtggtccattaggggagacaacgattcgtatacgtggtgtgggttccgtaaacggctcagacccgttgatcattgtcgatggtgtacaaggagtagatatcgatgcggtaaatgcgaatgatattgaatccatgcagatcttgaaagacgctgctgcttccgctatttatggagcgaaaggtgcaaatggtgttatcgttatcacgactaaacaaggaaaaaagaacgaccgtgtacaagtatcttataacggttacttcggtgtagccaagatggccaatgacggttatggtctgttgaacgcttgggaagctatggaattccaagaagaagggcaacgtaatttattcaactaccgcggtggccaaacagtaaaccacgcccagttcggttcaataggtaaagacggtacaggtcatttaacaatgccttatgctatcaaacctgctggttatagtaaagaacagatcatctctcaatacggcagtatcgcagcttgggaagcttcttacaaagacaatggtgagaacacttggtctcgttccgcttactaccaaatgcttgaggacggctactctgaggaagaagctcgtgccggcacgaattggtacgacgaagtagttcaaaccggtaaggtgcaagatcaccagatttctatcaccggaggtggtgaaaaagcgacttattcagtaggcttaggctacatgaatcgtgaaggtacgatcaaggagtcatggttccgtcgttattccttgcgtgcgaatacaaacttcttcgtgaacaagtggttcaatatcggtcagaataccaacatcgccgtaatcgagaactcaggagaacgcggtcgtcaaggtgatgataataccttcggtaagaccttctccatccaaccttgggtacctatctacacagttggcggtgattattccggttcacaaaatgccgaaggaggacgtgctgagagcgcaccaatgtccgttgattatggcaaggacaatcgtcgtcgtttcttacgtgcccaatcagctatctacgcagagattatgcctttagaaagccttggagagaatttgaagatccgtactcagttcagcgcacgtttaggtggcgcatgggacttctggatgaacaaacgtacgatcatgaccaataaagaaggacgtaacaacaacgagttctacgagcaagcaaactattggttagattatcaatggacaaacaccgctacttatagcaaaacaatcaatgacgatcatacgatcaatgctgtgattggtacagaggcacttcgtgagggtttaggacgttggatccaggcaggtcgtatcaactatccattcgaagatgatcccaacacttgggtaatcaacaacggtgctagctctgacttaagaaatagcggaaaccagaacgctgtatccaccatgttcggtatgttcgctcgtgcggactatgcttaccaaggtaaatatttggctacagttacggtacgtcgcgacgcatcctctcgtttttctgaaaagaatcgctggggtacattcccttctatctctttaggttggcgtatgtcggacgagaaattcatggagaaatcacgtacttggttagacgatttgaagattcgtgccggttacggtacaaccggtaactccaatatcgattcatataactgggcattccaatatggtactggtaaccgttatctctatagcatcaatggttctgacacagaggtatatcaaggatttggcgtaaccaatcttggtgatatcgaggcaaaatgggaaacatctaagatgtttaatgcaggtttcgatattacagcttttaatcaacgattaaccgccaacttcgactactacatcaagaaaacttctgatatgttgatcgatgccaactggtctgctttggccggtgccgctgacaagccgaaagtaaacatcggtgatatgacgaacaaaggtgttgatttgaatattacttggaatgataaaatcggtgaggtaggttactctgtaggcgtaaacttgtcgcattacaagaatagactggatgagattggtactgatgccggaatctttaccggaactcgtatttccaacatgaacgtattgatgaaaggacatgcaatcggtgaattccacggttatcagctagatggtatctataagagtgaagaagaagtccgtaactataagaatgatgccggtggaacagtattgccatatggtacatctgatgcttctacgttaaacgctgccaattatgtaggtcagttcaaagtaaaagatgtgaacaacgatggtaagatcgacgctagtgaccgtacattcattggaaacccacatccggatttaacaggaggtatcaacttaggtgttaactggaaaggattcgacttaagtacttatatgtacttctccgtaggcaatgatctattcgccatgtataaatattatacacattatggttccttacagtccgcttattctaaagatcgtcgcgacaattcatggcatcctgtaaccaaccctgatggtatctatcctatgtgggcaaccgctaatggtgagagtacaatcgccgcaaatgagtctaattccggctatatagaagatggttcattcttacgcatgcaaacgttgactttaggttatacacttccaaagagtattttagataaaatcaagtttgagaagatccgcatctatggtcaaatagcaaacgtattcacattgactggttactccggactagacccacaggttcgtacagatacagacggtcgttccaatgaccgtacgatgggtaccgatttcggttcttatggtatgccacgccaatttatcatgggtgtaaatgtgacattctaacaaatatttgctaactaaaaattgaaacaagatgaaaaatctatttatatatgcggcagtcattgccgccacgatgggaagcatgactgcttgctccgatttcttggatgtgaagccagtcacaaataaacaggaaccggattttgtatcgcaagaaggtattactcagttgctaactggtatgtacgctagattaaactctacagatgcgaatgatggatacttccgttcgacattgaccaactatgtatatggtgacgtaatgggaggtgacgcaaacaaaggttcaactttccaagaccaaccagactttaccagcttggaaacttatacatttacaactgacaacgcttattttgaaacaaaatgggcacatagttaccatggggtattcaccgcaaacaacgtaatcaaggtagcggatttagcaaaagaagagctttcggctatagcaggccaaagtaaagacttctatacggaaacaatcgcccaagcccgcttcatacgcggtttcttccatttcgaggtcgtaaaattatttggagcggctgttccttatgtagatgacatagccatgaaagagaacgtgaacccacaagtctctaatgtggatgagaatgggaattatatctatatctgggataagatagtagaagacttgcagtttgcctatgacaatctgcccgacacttggaccgaggcaggacgcgtaaacaaatgggcagctggcgctatgttggctaaagtaaagatgtaccaatcctctccatataacggaaaaaatggaacgtctaatcattggactgaagttaaaacgattttggaagatgtaatcgcaaacggaaaagataacaaaggcactaagttccgcttggcagatacatacgaggaactctatacagcaggggaaagtgactggacaggagaatctgtattcgatgtccaagctgcagtttccggcaccgtagaacaaactgccaatatcaacggagcttggcacatcggcttcagcggagcgttaggaactggaggttggggattctatcaaccctcttatgatatggtcaacgctcatattgttgacgcaaacggattacctaaaatggatgattcttatcgtaatgatcctgcgttatcaactttagacgagaacaatttacctcacactgatttgaccgtctatacagaccctcgtttggatgtttctaccggtcgtttcgagactccattcttagattggacagtgccaaatgcgttggatggttgggtacgtgatgtttctaacggaggtttatacctaaacaagaagaatatccctagaaaagccgataaaggaagcttatctaacacgacgcaaacaaactccactgctaaaaacttccacttgatccgttacgcagacgtattgctttggtacgctgaaaccttgatcgagttaggacagcctcaacaagcaggtgaatacattaatcaagtacgtgctcgtgccgccaatagctatgtaaaggcagtagatccggcaacaatgaccgaggctagttctacttatgttttggatgacaagattaacgggaagcaaagtacagatgctgccgcaaactatcgtataggtttatatccaccttctcaattcgcatcaaaagacaaagcgctggaggcactgcgttgggaacgtcgtatcgagttagcgatggaaggtcatcgctggtatgacttagctcgctggggtatcgcatccgaggtattaaatgatttcgtgaaatacgaagctaagcatttaggtaaatattccaatagtacatacaacgcaaaatgggcaacaatgcctatccctcataatgaaatcttaaagatggatggtcttttagttcagaatgaaaactggaaataaacaagtgggttaacagtcagaaagggcagccgggcatgtgatatgtccggcctgctttttaatccccaaaagttagttaacttactttgctcacgaagttaacatactttgccaacgaagttaactccatgtgccaattaagttaacttcgttttgtgtagattggtatttccgataaaaatcgtatctttgtttgactttaaatcaaaatgaaacgtgtactctagccatgagatataaacaaatactcctcggtttgatcctgtttgtcctattagggggtttcttgcaaataaccggcaagtttcatttcttctatatcgagcagcttcaactattccagttttccgaagattatcttgcggataaaatcagcagtccgggaggtttatctttgattatcggggaattcttgacacaattctttattacgccttatgcagggcctttcattatcgcagctatacttacgtctatcggcttaacaatgagggagatcatcctgcaaattaatccaaataaagagctcttcctgctttacttactcccggttttattcttattattgattcaatacgacttcaattatttagtacaaggcactatcgcattcctattttgtttgattagcctgaacgcatggatgcgcataaaagatccctgttaccggctatccgccgcattggtaatcaccccactacttttttggataggaggaccgattgccgggctgttctcattaagtgtggttctcaaggaagcgataagccgttccaaacaggggttctattttttagcggttttaattgaatacctgtttatcgggatcggaagtgtctggtcaactaccatcaccagttatcgcttcgcattcttaccggacgctttttaccacccgattctggcggctcccaatctcatctatttcgcatgggtctgtttaccgcttagcttgatcggggcattcgtatatcctaaaggcaaaaaccaatcaaagaaaaaaacagggatagagcttaccgttcaattcatcctaatcctattcctttgctgggtaacgattccacggtataacgaccagaaagcctatcctctaaaagtcttggattattatgcccgtaccgaacaatgggacgagatcatccggcattgtcacgggccgatcaaaaactatttatatttaacttacttaaatagggcacttgcggaaaaaggggagttggcagaccggatgttcgcttttgatcaacacggtcctcaagggttactcgcctcttggaacaagacctttacggtctccaccctgttaagcgacgcctattttacgctaggggaaatcgcattatcgcaggagatggcttttgaagggtatgtcaccgtaattggcgccggtaatccccggaacctgcaacggcttgttcaaacaaacttgatttacggaacgtatcctatcgccgagaaatatatcagtatcttagaaaaaacatatgcctatcatgattgggccaaacggcatagaggcttcttatataacgacaaagcgattgaagctgatccggtattagggcctaaacgaaaagctcttccgaaggaaagtaacttatccggtatcaacggactggaacatgatttacttatccgtgcggaacaagatccggaaaatcagctcccgatccaattcaccggggctatctatctgctgtctaaagacatgaaagctttccaaaggctgatagaaaagtattatggaacaccggtactcccctctctccccgtgagtttccaagaggctgttatcctattagcagagaaggatgtggattactggaagcgttttaacgtatccggaaatgtgatccgcaaattcgcaggttatcggaatttagtcgtgcagaaccggaacaacccacaacttccgcaacttataaagaagtcgttcggagacacttattggtcttattatactctaaaatgatcaacaaccatgaaaagaaatattctatatatcacctgtttatttcttattctactaggaatatcctgctcggatacgatcccggtaagcaaagaaacctcggagaaacctgtattatttcccgattatgcggatgtgacgatcccttataatatcgcacccttaaatttcaagatacaaaatccgcatacggaagctttcgccgtactcaaattcggagaagaaaagatacaagtcaaggaaaaagggggacaattctatcttcccgcatccgattggagaaaattgctgaaaagggcaacaggaaaagcgatacaagtaaagctctacgcaaaagacaaagaatggctcgcctatccggaattctcactattcgtcgctccggaacccatggattcatatctggcttatcgcttgatcgaacccggatacgagctttggaatcaaatgggtatttaccaacggaatctggaagattataagcaaagccctatcatggaaaacaaatacagcggtcaaaactgtatgaattgccattctttttgtatgcaaaaccccgataaaatgctgttccacatgagggataagtattcgggcacttatctgatcgacggagacaagatcgagaaattaaatacgaagaccgatcagacgatctcgcctttggtctatccctcttggcatccatcggggaaatacgtagccttctctgtcaatcagaccagccaaagctttcatgccaacgacaaaaaccgggtggaggtcttcgacagccaatccgacgtagttgtatacgatacggaaaagcatgagattatcagtacgccttccattcggacagcaaaagcgtttgagactttcccgacattctctcccgatggcaagactctttacttctgctcggcagaggcacgttccatgccgcatgaatattcagaagtaaaatataacctttgctccatagcgttcgatcccgtaacccggagtttcggctcccgtatagataccttatacaatgccggaaaagatgggaagagcgcctcttttccccgtgtttccccagacgggaaattcttgttatatacgctgtccggctacggtaacttctcgatctggcataaagacgcagatctatatctactggatatagcgagcggaatctctcattccttgcaaaacgccaatagcacggatacggagagctatcactcatggagtagcaacagccgctggatcgtcttcagcagtcgaaggatagacgggttatacacacgtccttattttgcttatatagatgaagaaggaaatgcgtctaagcccttccttttgcctcagaaagacacagactactatcaccgtttcatgaaatcttataatatacccgagtttattaccggaaaagtatcctccaagatccgggcgcttagcacgctagccaaagaggataaaggaattgacgtaacttatcgtaaatagaataaatcacatgagtactttatataagaagatattaccaccgcttccattcattctattgaccggcgtcttatggtttcatttgcagaccatgcaagagcctctctttttttatcgggaacagcagcagattttcctattcgattccacctatatattcagcatacttaagcagataggggggctagcgacttttatctctcaattcttgatacagtttttcaggatcccgcttatcggatcgctggtgaccgccttgatcggtggaatctccggttggttattctggctgaccttacgaaagatacatccggcattatatcttatgcccttggcctttctccccatcctattccaatatctttacctaatgaaagatagctatcattatgaaggactgatagccatgttgttttggtcattggcgcttaacgtatatagttacagcgcacgaagatttaattggacgtaccgtaccttaattggttgcttgctggcgaccggattgttttacacgatgggatctgtagctatattattcgcccttagcatcttactatttgatgtattacaaaaatgcgaacgctggtacgcaagcttcatcccgttgctgctgctacttatcgtaggctccctatgtgtcctaggaggcagtaaacccgattatgactatgtattttggatgaaagattacgtagagtatttcattgagctggaaccattctacggcttctcttggcaagtagcgctactcgttatgcttctattcttcctatcacgttacttagatcacataaaaacctatttaaaagctttagtagccgtagcattacttgccttatccggtatgtattatacgcaaacggctcttcaacagaggaataaagatttctatacgttgatgcaaatgtttcattacatagataccgagcaatgggacgccataatctcgtccgccgatctaaactataataactacttacacctgaattgcttaaaccttgccttatcccacaagggtgtcatgcagactgatttattcaaatatccgcaaagcggaatacaatctttggtctcaaaataccaagcgcatatagaggaaagtttcctgttcagccagatatactaccatgtaggaatcacgtccttggcatacaatttcgcttttggtacctcggtaggaattacatacggcagtcccgtcatgaccaaattattaataaaatcccatttgatatacggacagtatcccgcagccgagaagtttatatccttattggaaaagacatgggcctatcacgaatgggcctcctcgcaacgaaagttcttatataatgaccaagcggtggagagcgacccggaattaggtacaaaaagaaaaagcctatccagcgacaaagaccttttcgccaatataatcggattgtttgataacctgatgattatattggaagagaatccccagaataaagccgcattggattatacgatcggtacgttattattatcgaaagacctgcccgctataaaaacgtttgttgaaagattcagtgggacggaagtactccctatattacccgaacccttgcaacaagccgtgatctcttatgcggagcatgatccggaatattgccgcaagtatggggtaaccgataaagtcctgtccgagttctcgatattcaagcaacgtgtattgggactaaggcatgcccgacaaaatctagcgactggaatagccgactatcaacctactttctggtactatttgatactctctaaataaaacacatatggaaagacagacttatacaaatacaaaccgatatcttttcctttttctcatcgccttgatggtttcatgctccaaaaacgacatacagatcgccaagagcttaaacaaggaaataaccatttatccggattacaaggatgtgaccatccctgtgaacatcgccccgctcaatttctctatcgccgatagcagtgagcactgccttatcattaaaggggaaaagactcaactccaagtctatagtgatgaggggctctttgagatcccacaaaagagatggaaagccttattgaaagagaatgccggaaaccaaatagaattgaccattgctaaacgcatacagggcgaatggaacgcctatacgccttttcatatggacatcgcaaatgattccattgataaatatatagcctatcggttattagccttgagcaatgatatgtggaacaggatgggtatctatcaacgaaacttggagaattatgaccaaagcgtgatttatgagaatagcctaaccgactataactgcgtaaactgccatacgttttcctccgggaacccggataaaatgattttccatatgcgaggcaaacacgctggttccgtactgattgatggaaagaaaatcaccaagctaaataccaagactcccgagaccgtctcaaactttgtctacatgtattggcatccgaatggtaactatctggcggccaccgtatgcgatacctaccaaaacttcttcatcaataatcccaatacgctggaagtattggatcataattccgatatcgtgatctacgacgtgaagaagaacgaggtattctcttgcgaagcgttaaattccaaagacgcatggcaaatattccctgcgttctctcccgacgggaagagcctctatttcagttcgaccgccgccgtagattctatttctaagaatttcagacaaatgacctacagcctatgccgtgtcgactttgacccggaaacccgcaccctaggccagcaagtagatactttatacaatggccgggccaatcacaaaagcgtatccttccctagaatctcaccggatggtaaatatctggcttttaccctacaggaatatggcggtttcggggtttggcataaagacgctgaattatatatgatccgcctatccgacggaaagacgtacccgctgagcgaggcgaacagcgccgaaggagaaagctaccattcatggagccacaacaatcgttggctggtatttagcagtcgcaggttggatggattatacacacgcccgttctttacctatatcgatgataaaggtacggcccataaaccattcctcctgccgcaaaaaaatcccgtaaaatattataaagacctgttgtggacttacaacctcccggagtttatacaagaaaaggcccaagtagatacgcatgccgtgatggaaaccatgagaaatacaaaaggaatccaagtaaaataagaacaatagctagggtgggcgaaaggagataaggatgtctgtttggttaaatctacccacccttagctattgatctgtttgctcactcttttatcttcaccgagaatagaaatagagcgtttcaaatcaacgcccatatttccatttgttgtattcataaaataagtacaaactttcggcaatcagatttcactctttagtgaaacaaacatatgtaatctgcgtttatagattatcaaatgtctctttaaaaacttgagacaaaaataaactattttgatagaaaaataggtctgtaaatattcacattttattcacaacacacaccaaaacgttcatttatcctaggaagcatcacaatttaacatttaaccgctccatcatcactccggtcttctccctagcctccgtcacatccaaaccacgagccagcaagacggccatacggcgatgtccatgaacttccggttttccaaagaaacgcatctgcgtatcgggttgttccaaaaccttatccagattccccaaagacaaccggtcactgtccccttccactacaacggcacgggaagctcccgctccatgaaacacgatattagggatcggcaagccaagcaccgcacgggcgtgcaaagcgaattgagacaaatcctgtgtaatcatcgtcaccattccggtatcgtgcggacggggggaaacctcgctgaatatgacatcatctcctttaatgaataattccacgccgaaaataccacgtccgcctaaagcctcggtgatcttaccggcgatctcacgggctttcgctttagcggcaaggctcatggcttgcggttgccaagactcccggtaatcaccgtccacctgaacatgtcctacgggttccaagaaagacgttcctccgatatgccgaaccgtcagctgggtaatctcatagtcgaaatccacgaaaccttccacgatcaccttacccgctccagcacgtcctccttcttgggcgtactgccaagcacgatcgatatccttttcctcacgaaccacgctctgtccgtgtccgctcgagctcatgatcggcttcaccacgcaaggcataccgattaccttcaccgcttctttgaattcctcctcggtctcggcgaaacgatacggcgaggtaggcaagcccagctcctcggccgccaagcggcggattccctcacggttcatcgtcagccaagtggcacgggcggtaggaatcacatggtatccctcttcctctagttccatcaaggtacgggtagcgatcgcttccacctccggcacgatataatccggtttctctttctcgatgatctcccgcaaggcatcgccatccagcatggagaccacataggaacgatgcgccacctgcatggccggagcgtccggatacttatccaaggcgattacctccacgccataacgctgcaactctattacaaactctttccccaattcgcccgagccacaaagcacgactttagttgccgtagccgatttgggcgtaccaattgttaccataaatctttctgctatttgaatttcgccgcaaagttaagggtttatgcctgtatagcctaaagcttttccctttatctattagggcaaagataaggttagcttcatcgtccaacggctggtggacgatcatgcaccagttggtagatgatcatgcaccagccgttagaagatcatgcatcagttggtgcatgatgaatgtatctttatgaattgggtaagacagccgcttgtttggcctacaatatacagaggaaaggaacaaggatctacttataatcaagacctctttgttaatattacataattagtagtaccttgcgatacaaggtatcttagtaaaacatatatttgtaaccagatgataaaagtgttcaccaacagtgtaacttatttagcaaactgtacgtctaatatataaagtaactacataatatgatgattcaactgaaaggaataaacaaaacgtactttaacggagccccactgcacgttttgaaaggtatcgacctagatatagagaagggagagatggtatctatcatgggagcgtccggttccgggaagtcaaccctattgaatatcttggggatattggatacgtacgacacgggcacctatctattaaacggacagttgattcagaatctaagcgaaagccgtgccgccgagctgaggaaccgtatgatcggcttcatcttccaatcatttaacttaatctcgtttaagaacgcagtggagaacgtagctctcccactctattaccaaggcgtaagccggaagaagagaaacgccatggcactggaatatctcgacatggtgggattgaaggattgggcggatcatatgccgaacgagatgtccggcggacagaagcaacgtgtggccatcgcacgtgccttgatcgccaagccgcagattatattggccgacgagcctaccggggcattggatagtaccacgaccgtggaagtgatggaactcctccgtagcgtaaaccaagaaggtatgaccatggtgatcgttacccacgagccatccgtggcggaagctaccgaccggattatccgggtaaaagacggattgattgaatacaccgtaaacgaagaatcgcatgtttgattttgacaattttagggaaatatggagcacgataaagaaaaacaagctccgtaccttcttgaccggtttcgccgtatcatgggggatctttatgctgattaccctgctgggagcgggaaatgggttgagaaacggcatcatattcaacttccggaggttttccgccaataccgtggaggtttgggggcgctataccaccatgccttataaaggtaaccccacgaaccgcaggatcgagttcaaggaagcggatctcagcggcatcaagatggcattcccggaaatagaatactgctcggctaccatttcgcaaacagataccatctcgtatggggaagaatacatcgtgggcgacctgcggggcgtatccgaggattacaattccattatatatattaatgtagcgagccagaacgggcgcttcatcaataagatggatatgaacgctacacgcaaggtaatcatactaagcccccgtatggcggaagtgctattccgtaacgaggacccgctgggtaaatacgtgaaatgcggcaatatgatgtatcaagttgttggtatctatgatgatgacgacaagagtaacaacgcgcccgcatatataccgtttaccgtagcgcaacaactttataataaaggcttcgggttcggctccatttactttacggtaaacggggtctccaccgaagaagagtgcaaggatttcgagaacaggttccggtcgtatatggcccgtaagcacatattcgacccgacagacaagaatgccatcggtatgtggatgaccggcaatgagatccgtatgttcaatacgatgacagacggtatcttgctcttcatctggatcgtaggtatcggcaccttgatggctggtatcgtgggggttagcaacatcatgttgatcaccgtacgcgaacggacccgggagttcggcatccggaaggcgatcggggcgaaaccggcctcgatattgaagcttgtcatcgtagagtccatcatgatcaccgccatattcggttacatcgggatgctgatgggaatcgggttgacggagctaatcgactatggcatgacgatgagcgggatgaacaacgcttcatccggaggaaatcccggcgaggatcttaccttattccggcacccgaccgtcagcctagggatatcgctggccgctaccggggtgctggtcgtagccggggtgctggcgggctatttccccgctcgcaaagccgtgaatgtatccgctattgaagccatgagaacagaataaaccgaaaagatatgtttgacatagacagatggacagaaatatgggtaaccatcacccgcaacaagacacgtagcttgatgacttgcttcggcgtgttctggggaatccttatgctggtattgttgctgggtaccggatcgggattcaagaacgccatgttcaagagcgtcaacggattcgcgacgaattcgctattcttctacgccgatcgcaccagcgaaccctaccaaggattcaacaaggggcgaaactggaacatgaggaaccgggacatagacgccatcatacgagacgtacctagcgtacaggatatctcccccatcctttggggcagccgctcggaaaagaatatcgtttacgggataatgaccggaacgttcaacgtgaaaggtatatatccggcttacttcaatatcgatacgcaagacctatactatggccgtttattgaatgagatcgatatgcgggaaaagcgcaaggtttgcttgatcggcacgaagatcaatgaggtattattccacaacgaggacccttgcggcaaatatatccgggtgaacgggctttactaccaagtagtaggagtggtcaaccaaagggcatcgggcctgaatctgggcggccggggagaagaaaccgtcttcattccgttcaataccatgcagcagaccttgaaccaaggcgatatcctgcatttcctcgcactgagcgtgaaaccgggatatccgattgagacgacgatcgagcaggtcaagaatatcatgaagacgcaaaatcagatcgcaccgaccgatcctcaggcgataggcgtagtcaatatcgccgcacaattcaagacattcaatctactgtttacaggtatcgacatcttggtctggctggtcggcatgggtaccttgctatcgggtattattggtatcagcaatatcatgatggtaacggtaaaagagcgcacgagggagataggcgtacgaagggctttgggagccaagcctttcgacatcatctcgcaagtcatgagcgagagcttggtgctgactgccttggcgggcttactgggattaagcgccggagtcttcctcttggatttgttggataagatattgtccgccaatccaacgaacgatccgaccctgctgaatcccggcgtaaacatccaaacagcggtagccgccgcggtggtactactgataagcggttttatggccggactgattcccgcatggagagccatgcagatcaaagcgatagatgccatccgagatgaataataacgaatcgataattaaaataaaactatataatcatgaagaatcgcatcgtaaagaaaatcctacgtattatcttattaacgatcgtaggtgcggcggtaataggcacattctatttcttatggaagaaggcgcaaccggtaataaccgtttatgaggtcgtaacccccaaaagggatacggtagagaccaagacggtggccaccggaagcgtggaacctcgctacgaggtagagatcaagccgcagatatccggtatcatctccgagctaaggaaagaagcgggacagatggtacaggcaggggagattatcgccacgatcaaggtcataccggagatggtacagctaaatagcgccgaatctcgcgtaaacatagcggatatatctcttaaacaggtggaggaaacctataagagagatgaactgctgttcaagcaaggtgttatcgcccaagaggatttcgatctctcgaaggccaactacttaaaggcggtcgaggagaaagcgaacgcgcaaagcgcactggaaattattcgtgacggtatcgccaagaactccaatgtagccagtaccacgcagatccgtagtaccatcaccggtatgatactggatatcccggtgaaagtaggtaactccgttatccaagcgaacaacttcaacgacggtacgacaatcgccacagtcgccaacatgaatgacatgatcttcaagggaaacgtagacgagaccgagatcgggcgcattcacgagggaatgcctatcaagcttacgatcggagccatggaaagccgttcgttcgaggccttgctagaatatgtatcacccaaaggtgttgagaaaaacggagccattcaatttgagatcaaggcagccgtgacgatccccgaagatgctttcatccgtgcgggatatagcgccaacgccgagatcgtgctaaaacgtgcggaagacgttcttacgatcccggaaagcacggtcgagttccaaggggattccgcattcgttcagttagttaaacaagagcaaccggagcaagtcttcgagaaacatccggtaaaggtaggtctgtccgacggtatcaagatcgaggttcaagaaggactggccgcgaccgataaagtccggggcgcagctattgacccgaataagaaataaaagaaagattgtatgatgagaagaaacttatatatactggcaatcgtttccctcctgtccggaaactatgttttcgctcaggatgcggtgaagcaatggagtctggaggagtgcatccaatatgccatcgagcataatatcgacttaaagcaaaaggagcaggaacaggaaagccgaaaggtagacttacataccagcaaatacagttggctcccggccctaaacggcagtcttggacagagcttccagttcggacgctccacgtctaaatccggggtgatcgtggaccagaacgccgccaattccacattggggatcaatctggacatgcctttatttgacgggttaaaaataccgaacgatatcgccgcccgcaaacttgatctaaaagcgtctatcgagaacttgaataaggcgagagaagacctatccatcaatatagcttcctactacctgcaagtactttataataaagagttactgaaaatagcgcaactacaagtggaactagacaaggagcaggtgaataaaacagaggccatggtgaacgccggaaaggtgccactttcccaactgtatgatatcaaggcccaattagcgaaagatgaggtcacgcttaccgagtcgcaaaacaatgtgaacctcgctttactggatctggcgcaaagtctggaactagagcgaagcgatcggagtttcgatatacagactcctgtaattgaagatgcggtggctgataatatgagtagcatcctacctccggaaaacatttacgatcatgcggttacgttcaagcctcagatcaaggaacaacagtatttgctagagagccaaaagaaaatgttgcgtgtcgcgcaagcgggctattaccccaagttaaatttcggggctagttacagcaatggatattatcattctacttccggaggtgaatttgccgatactcgttcctttagcgagcagtttaagcagaatgggcaaaagatcgtcggattctcattgagcattccacttttcaaccgcttccaagtacgcaatagcgttcgtaccgcaaggatcaacattatcaaccgggaattgctgatggaaaatacaaagaaaacgttatacaaggaaatccagcaagcgtactacaacgcaacggcttcccaagagaaatatacggcttccgacaaatccgtcacggcgagcaaggaagcgttcaattatgcccaagagcgttacaacgcaggtaaaagcactgtctttgaatttaatgaggctaaaacaaaatacgcgcaaagtctagcggaacaggcacaggccaaatatgattttatcttccgtacgaagattctagatttctataatggtaaccctatccgtttataaacgttaattaatacttcatttttttattatacacacaaagtttaagggaagatatcctttatggacatcttccctttcagcatccattaaggcatttagtctgcacagaactatgtttaacagcataattaacagatagatagctaagaccaaaaaccctcctgccagctatcataatgcaacaagatccccagtacaactaaattgaatttgacaatatcaatcaatattatattagttttagaatgttttataacagtttgcttttttataataaaaattagtatatttgcggctgtgattttcaggagtcttggtgtgtacatttttttgataagtattttaactgtagttctgtgcaaactatggtctcttgaaaaaataatgtgtgtctaattaacaaacaaattcattctatgaagcacaaattaacgcttgtactactctcattctttctgggagtgcagtgtatggtcgcccagcaaatgaaggtgaccggtgtagtgattaatgaagatgatggggagcctgttataggtgcatccatcgtagtaaaaggaaccactattggaaccattaccgatttagatggtaaatttgagttagaaactcagaaagatgctaagctaattatttcttatgtaggtttacggactcaagaaactacagctcagcaaaacatgagaattgttctttcttcagattctcaagctatagatgaagttgttgtcgtagcttatggtaccgcaaagaaaagttcttttacaggttccgcatccacggtgggtgccgctttgatggacaaacgtccattgagtaacgccctctccgcattggaaggaaacacttccggagtacaaatgacttcctctatcggacaaccgggagaagctgccaaggtaacgatccgtggttttggttcagtaaacgcggataatgctcctttatatgtagtggatggtgccatcttcagtggtgatatctcttctatcagcccatctgatatcgaatcaatgacaattttaaaagatgccgcttctacatctttgtatggatctagcgcaggtaacggtgtggttttgatcacgactaagaaaggttctagcagcagtggcgcaggtgttaccttgagtatctcacaaggttggtctagcagagcttataacgattacgcaaaagtaggtgtatacgattattatcctttgcaatggcaaatgttgagaaacgcaaatatgtcactcggacaaagtgctaccgacgctgccgctaatgcttctaaagatattatcaacaaattaaaatataatcctttcgtaggaatcgccaatgacgcaatcgtgggcacagacggtttattgaatccatcagcctcggctttaaaatggggtgaggaccttgattgggaagatgccgcttaccgtaccggacatcgccaagaatataatgtaagctacaatacaaaaacagaaaagagcgacacatatgcttccataggctatctgaatgataagggatatatgattaagacagactttgagcgttacaacgcacgcttgaactataatatctatccggtgaaatggttcaagagtggattgaatttaggtttaagtcgtacaaactccaattattctacttctacttctagcaactccgctggttatggtaacttatctcgtttcattcgttctatggcaccgatctatccggtacataagcatgatattgagacaggggcttatttggataaagaaggaaacgtagttactgatccggctttatatacctacgattatgaaggagcccgtatctccagcaatggacgcgacggtatcgctgaggccctgtggaacgatcgcttgatgtctaccacaaactctagtgcccgtacttatgtaacgatcactccgatcgaaggattgaatttaacagtgaactacgcatttgacaataaggatgaacgccgtagagtatatgagaacccagaggtaggtgacggaaccgcaggaccgggacgtttgaacatccgaaatagaaacttcttgacacagacattcaaccagttgattaattacacaaagacttttggtaagcataacatcgaagctttgttaggccatgagaactatagctaccgtttacaatataactacggtatgaagactaatgagatcgtttccggaacgtatgagtacagtaacttcgtaagcataagctcaatggattcttatacacgcgaatataagaaagaaggatacttcgctcgtttgaactatgatttcgatgataaatattatgtaacagcctcgtatcgtcgtgacggttcctctcgctttagcaaggataaccgttggggtaacttctggtcattcggagcatcttggcgtatcagccaagaagatttcatggaaaacttgacttgggtggacaatttgaaactgagggcatcctacggtgaaaccggaaacgatgccatctattatacagatgatgacacacaacaggattactatccttatcaaaccttgtataatttgggtatcaacaacggtttggaagcaggtctctacttcccgactatggcaaacaataatttgaaatgggagacacaggtttctaccgatgtcgctttagaattcggattgttcggtcgcttgaatggtacggtcgagttcttccgtaaggcctccagagacttgttattcaatgttagccaaccgttatccagtggtgtcgaaaagatcgtacaaaacattggtaaagttcgtaaccaaggggtggaaatcgacttaaactaccaagtattaaaatcaaaagattggaaattatcagtcggcgcaaacgctacattcatcaataataaggtgactcgtctgcctgatgccaaccggaaagatggtatcatcaaagactctaagaaattgatggagggacattcaatctatgagttctggttacgtcaatggtggggtgttaatcctgataacggagatggattgtatatctttgatgccgaaaacaacaccgatgcgaatggtaatattaaagatgcggtaaaaaagacacttgtagagaaagatggtcaagtattgacaaactcttatagctatgcgaaatatgatttcagtggttctgccgttccgaaagtatatggtggtttcaatatcaatttgagctataaggcattcgacctttctaccgtattctcttattcattaggaggcaaggtgcttgactcgagttatagaggattgatggatgtaggtgagttcggttatgcgatgtcaccggatctacataacgcatggacaactccgggccagatcacagatgtacctcgtttggacaataactcaggtcatgcgactagcattggacaatcctattctacacgttggttgacaaacgcaaattacttgaacttgcgtactgtcactttggcttacaacttgcctaagtctatcctaaacgttatcaacatcaagagtgcacgcgtcaatgtcagcgcagagaacttattcatgttgaaagcccgtcaaggtctgaatccgcaagctaactatgccggagtatcttacaatgaatatatgccggctaagaactttacgatcggtttaaatgtatcgttctaaattcataatacatcaaacaaaggaaaagatatgaaaaatatacaattattcaaacacatcgcagcaggactgcttctaagtggctctctgatcggcacaagctgttccagcgattatatggatacaatcccaaccgagaacgtttcattcacgacagtatccacttcgctcgacaatctttatcttgcactgaacggtattcatcgtaagatggtatctcaagacttaggcaaccaaggtttgggaggtgagcccggtttcatcatcggtcgagaagcgttagctgatgatttgacatgggacacgcagacttggcatcaaggtttcttaaactggagttatccaacgaacgcaacaagttcgtacaactccggtgagtgggaaacttattataagttcattttgaatgcaaacaacatcttgaaagcgttgaatgataactttagcgatgagtcaaaactcacagatagcgaaaaagcgcttgcgaaccatatcaagggcgagtgtttggcaattcgtgcatggagtcatttcaatctagtacaatattatgcgaaaccatatcgtaacggacaggacaactctcaaccgggagttccttatcgtacgagtccggaaatcgagcctatggcacgtaatacggtagaagaggtgtacacaaagattcacggggacttagacgaagcattgaacttattggcagactatgagccaaatgataagaatcattatagcctagcatcggtttacggattgaaagcacgtgctcttctgactcaacagaaatacgcagacgcagctacggccgcagtgaattctatcaatgaagcagagaaagatggctgtaagatcatgtctcagtctgaattgatgaatggtttcgctaatatcacttccgctacgaaagaggcgatgtatgccgcaatgacacagaatgaccaaacggtttatttctactctttctatgcgtatatgtcttggaacttcaactccagctctatccgcacaggtatcaaatgtatcagccaaagtacttacgacttaatgtcgccaaccgatcttcgccgtcaatggtgggatccgacaggaaaggcagaagtacccgcaacttcttacaaccagcgtgtttatcagaaccgcaagttcacggcacgctctacagctgatgctgtaggtgattttgccttcatgcgtatcagcgaaatgtacttgactgcagccgaggctttcgctcgttccaatcaagacgcaaaagcaaaggaatatttgcaagccttgttgaaagaacgtgatccagagtacaaggatttgggtaacacaggcgcaaaactagcggatgagatcatgacacatcgccgtatcgaactttggggcgaaggtttccgttggttcgacttgaaacgtctaggtttgccattggatagaaccgggtctaattttgacgctactttctgtggtttcttgcacaaggatccgaatgctgatggttggatcttcgagattccaaaaaaggaaacagatttcaacgacttgatcgaaaagaactattaacactctttttacgttaacttacattaatcacaatccccaaagtatactttaacaggttatctttggggatttcttatatcactatttatgaaaacaaatcatttattttcagctctgctctctttagcgcttatatgtcctggaatagcgcaagaaacacattatcaacgtcctccagccgtaatagaggaagtggccctagccaaattatccccgatcatccgaattagtgataacaatcagtgggcactccagttagagcgttccccgtaccggtctatcgccaagcttgcgcaaccggagcttaaattagcgggaatgcgtatcagtcccgaaacattcaatacgagccggcaagccgaatatacgggtgccagtttaatgaacatcgctactcaagaagaaatcaagattgaaggaattcctgacaacgcggtaatcacagaagcctcattctctccttcatccaataaggtagctctattcgtggaagaagcgaatggcgtatatctttataactgtaccccggaacagcccgtagctcagaaagtaagtacccgtaaaatcaatgcgacaagtggagcggagatcttatggattagcgacaatgagtttattacgcttatggttccagaaaacagggggaaggcaccggagaaacccacagtcccatccggtcccatcattcaagaaagtactggaaaggtgatgcccgctcgtacctatcaagacttgctgaaaaatccatacgacgagcaattattcgactattatttcacctcccaattggtacgtataaaagagggcattgtgtacgagatcggaaaaccagcaatctacggcagtacgctttcattatccccggataaatctttgctacttatcgcgacagttcatcgtccgtattcctatcaagtaccggtatataacttcccacaaaagttcgaggtcatagacttacaaggcaattccatttatacgttagcggataatccaaccgtcaatattccgatgggatatgacacgacctcgccttatccccgtcaattcggatggagatcggatcaaccggctaccgtttactgggcggaagcgcaagataaaggagatcctaagcaaaacaagaccgatttcatggatattatctaccaaataagctatccgttcaacagcgagaaacaggaagtcgcaaagacagagaaacgtttccgcaacatcctgtggaatgacgatgctttcgctttattgatcgagacttcccgggagactcgtaaaaacaggacatttacttttaagccttgctcttctgagtctccggttctattattcaatgtatccaccgacgataattacaacaatccgggaaatccacttacgattaaaaatgcgtatggtaaatatatcgtttataccaataaagcccacaatgagttattgatgcttgcccaaggagcctcacctaaaggggatatgccttaccttagccgttacaatttgaaaacaaaaaagaacacggaactttggcgctgcgaggacggatattatgagaccatcctaaaggtagcgaatccagaaaagcttcaattgatcacttcacgtcaatccattacagaaccagcgaatctctgttctcgtgacttgaaaaagaaaaaattcgctcaattgactcatttcgccaatccatatccggccatggcaaacgttagcaaacaaaagatcaagtataaacgtgcggatggtttggatctaacagcgaccgtatacctccctgccggatatgataaagcgaaggacggtccattacctgtcttaatgtgggcctatccgagagaatataaaagcaaggccgaggcttctcaggtacgaggttctcaatacatgtttacgaatatcaactatggttctcccgtctattgggttttacgtggattctgtataatggaaaatgtcgagatgccgatcgttagtaccagtgagggagcggagccgaacgatgatttcattgagcaattgacaatgaacgccgaggcggccgtaaaagttatttccgagatgggtgtaggtgatccgaatcgtgtagccgtaggaggacattcctatggagctttcatgacagcgaatctattaacacataccaagctgttcaaagccggcatcgcacgtagcggggcttacaaccgtacgcttaccccgttcggcttccaaacagagacccgtacttattgggaagtaccggaaatatataatgccatgtcgccattcatgtctgccgataaactacatggagctttattaatcatacatggtgagatggataacaactccggaacctttccgatccaatccgagcgcctgttcagtgccctaaaaggccacggggcgatcgcacgttatgtcgtattgccctatgagagtcatggctacgccgccaaagagaacatattacatctattgtatgaatgtgacctatggctggatcgttacgtcaagaacgcaaaaaagtaagtagtactgactttgtcaatgaagtatatatcctctgacaggaaaagtatatttcctctaaccagtgaagtatatcttctatgaggaagccagccggcagccaccaattgccctaaaacaacgatgcccatcgtaaggttataagaatgcccatcgtaaactccttacaatgggcattcttaactccttatgatgggcattcaaagaaagccctatctgagattcgtttattttagcaatgaacaaggacaaagatgatccttctcgatatccttgaaatagttataagtacctaccttaagatccgcacaagccgcctcatcgcaaacaatgattcccttcggatgcaactgcaaggcggtaattgtccacatttggttcacggcaccctcaacggcttgttgcaacgcacgagccttgttatgaccatttaccatgatcaatacctccttagcgtcaagaaccgtacctacaccaaccgttacagaagtcttcggaactttattcacgtcattatcaaagaaacgggagttagcgataatcgtatctgtagttaacgtcttgatacgagtacgagaactcaaagatgaacccggctcattgaacgcaatatggccatcaggaccgataccacccaagaacaggtctacgccaccgaccgctttcatgcgagcctcataagacgcacactcagcctccaaatcctcggcgttaccattcaagatatttacgttctccggtttgatatcgatatgactgaagaaattattccacatgaaagaatgatagctttccggatgatctttcggaaggccgacatactcatccatattgaaagtgatcacgttctggaacgatacgacaccctgcttgttcaattcaatcaggttcttgtacatacccagcggagaagatccggtaggcaagcccagtacgaatggtttttcagcggttggattcgcggctttgatcttcgctgctacataattggcagcccattttgagagttgctcgtaattaggttcgataattaatctcataacgttacgctttttttaattgaaaattgaaaattggaaattgaaaattaaaggattcccaatctacgcatctcgcctttcttttgtttataaattagatctattgttaatagctttcgttttatctgttgtcggagcctttagacttttcaattctcaattctccattttcaatttcccagccatttccttgcccaaggctaaacactcctcgtatttagtagcgcttaaaccttgcttctgctcaaccggcgtaccgacagtctcccacttcatcttctcgccaaaagccgccaaacgtttcacggcggctccagcccatgtgaaagacccgaaataaccgaaaatacgatttttcacctcacgcaactcgatcttactcaacacagcttccacctctgggaacaattgattgctataagtcgggctacctacgataactcccttatatttgaacacatctttcaagatataagaagaagggcttttgctaacattatgcatcacaatattcttgatgccattatcagccaaagaagcggcgatcgcctcagccatctgctccgtgttaccatacatgctgccataaataataaccacgccttcctcaccttcgtagcggctcatacggtcatagatatcgatcgctttcgacgcatattcacgccaaacaggtccatgggtagagcaaatcgtctggatatccaagcccgaaagcttctgtaatgctctttgtactggacttccatattttccgacaatgttggagtaatagcgaatcatctcttcccaataatgctccacgttcatctccgtatcgatcacaccaccatccaatgtgccatacgtaccgaacgcatccgcggagaatacgattttatccgtaacgtcataagtaaccatcacttccggccaatgcaccatcggagccatataaaatacaagctcatgacgacccgtattcaaggtatcaccctctttcacctcaaacaagccttccttgatgccatgatatccttccagcattccgaaagtcttattgtttccgacaatctgtacgtccggatattgctgacgcaacaaacggatacttcccgcatgatccggctccatatgatttaccacgagataatccaaagaacgtccgtccaaggcatccgctacttttttcaagaaaatatcagagtaacaaacatcgaccgtatcgatcaatacggttttctcgtctacgatcaagtacgagttataggaaacgccgtatggcaacggccacatattctcgaagagggccttttgacggtcattaactcctacataataaactttatccgcaatttcttttaacttgtacatcttttttaattgataattgataattaaaaattgaaaataacaaagcgtgtgctctctaattttcaattctcaatttttaattttccatttcttagcgctctccagacaaaccagcaccctgccaaaacaaacgggatacttagccattgccccatattcaacatcattccagcctcgaaaggctcttggtcatttttcacgaattcgatgaagaaacgagacccgaatacgcatatcataaatacgccgaagataagtccttgctttttccatgcctctttcttgaaatatagccacatacagatagcgaacgtcaccagataacaagcggcctcatacaattgcgtcggatggctcggagctgtaaaaataggctccgcccccattctccatgcgtgtaaattatcgataaaacgaaatccccaaggcaaatcagtggaatgaccgtaaatctcatgattcatcaggtttcccagacgaatcatagcagctaccaatcctgtcggaaccaccaacttatcgaaagcccataacatacttttatggcttactcgcttcgagtagaaataaatggcgataattatacctaacgtaccaccatggctagccaatcctccctcccaaatcttgaaaatctcaatcgggttggctaaataatattccggcgcataaaacaaacaatgccccaaacgggcaccaatcaccgtaccgagcatcgtataaatcaaaagggaatcgatccatgcgggcggcagtccctcttttttccacatccgctctacaatcatatagccaatagcgaaaccaatcgcaaaagccaatccataccaacgaatctcccgggaaccgatggtaaagatagcgggatcggcagtccatgtaataaaatcaagcataattatttcagttggcaattgacaattgacagtcgacaatcgcaagtcaggatttcccgaactgtcaattgccagctgtcaaccatcaacttatattaaacgagtcttctaattaagttctctctctcgccgtacagcatatcgattatcggcaattcgatcatcgtatatgcgcccggttgttgcttcaagctcgcacgagcgacagaaaccaagatttgagcggtcaaggcagggttattgatcttcatatcgaattcgatcaactggttctgagtcttgcccgatacacctttacgaaccaagttcacaccatgtcccatgtccaacaaattatcgacacattcaacctgcattacatgagtctcatcatgagcgaaataatcatccgccttgatagcggcagacacttgcttgaaatcgtatccgtcttctacctcgatataaaccatacgacggtgtacacctgttcccaaaggaatcgtcatacttaaagccgccttcacgccttcgatagccttcacggcaaccgtatgccccatactcattcccggaccgaagttcgtataagtaatacctttcggcaccatcgcttctaacaaagcacgtaccacagagtcgcttcccggatcccaaccggcagaaattacagctaccgtattatgagccttcgctacagcgtccaaagaacgacgtaaatccacgatacctccgtgtatatcgaaactatcgacagtattgatgcctaaagccagaatctctttcgcatgctcttccacgctacgtgtaggagtagccaaaaccgctacgtcaaccttatctaacttggtgatgctatcagtaaccgtgtatgccttcaactcgtccggaatatcattcggattacgacgaataatacctgctacctcaaaatccggggcagcttcaagggcctctaacacatatttcccgatgttgccataacctacgatggcggctctaattttcttcatactctagtttttacttttcaaccaaccgcaaagttagatataatttagagctttaacaataaggaatacagtttttatatcattttcagaatgatatagatcctcactctttcacgaatgaatccggataggtagtaagctgctctacaccggctttcgtacgaatccaagtcttgaaggtacgggctccctcgttcaattcgatcacacgtgctccatttggtatatggatgtattccgtcggaccacccgtaaaacgaccgtaagccaataatacgtcataccagcaaaccgcataatcatcgtcatgatcatgaccgacaaatatacccatcacgtccccgttctccttaatcgccgtaaataagccggaattcaaggccggagcgcatgccttttccctacgtatgccatagagttgggcattctcatcggaagccgcttgattaaactccggcaacgcaatatggaagaaagccaaagaaggaaccggctctcccccgttattccgggtaaactctgcgcttttcttacaataccaatcgatctggtcacgcttaatataatcgtatccttttacccccttgatagttgaataggtattcgaatcgatgcaatacaagacgaaagcatccttcttcccgtcggaggaacgtacggtcaaggcgtaattacccacgcctgagatttcgggaacctcatccgccgttaaactatacggtaggctttcggctactttcagcaactcctcttttgtcgccccctgctcattatcatgatttccgaaaacaatggagaacggtattttacggtcggagactgtcttcaatacattccgcatattttccaacgcaggtttgctatagataatatctcccgtaaaaatcaccaagtccggtttctcgtcatccaacacttggttcatacgctcaaaagcgatgtccgagcgagggtcttgccatttcacatgcaagtccgtaaactgtacaatcttaaacttcttatccggattaaacttcaaccccgttttttgggcaaatcccaaagaactcaagccggcggccaataacaaggccccggcaaacatccactttctcacactcatcaaatctcgtgttttttgtaattaataattatttattcctttccgaaacaagcgtcgaacgcatgtgcggaaggttggaaatccactctcttcaccaattcgcaagattcccgtgccccatgttcccgatccatagcgctatcttcccattccacggaaagcggaccttgatagccaattgaattcaaagcacggataatctcctcaaaattaatctttcctcgtcctaagctacggaaattccaatatcgacggggatcaccgaaagtaacatgaccgccgaatatacccacctgcttgggggtatcactccaatatacgtccttcatatgcacatgaaagatacgctccggaaactgatagatgaaatccacatagtccaccccttgatatcctagatgactcggatcatagttaaagccgaaagcaggatggttatttaccgcctccaatgctctgcgtgcggaaaaagtatcgaacgcgatctctgtaggatgtacctccaacgcaaaacgtacacccagtttctgaaactcatccaagatgggcgtaaagcgacgggcgaaatcatcataccccttttgtatcatcgcgtccgttaccggagggaaagaatacaaataatgccaaatagaactacccgtaaaacctacaatcgtatcgactcccagcatctttgccgcatgggcggtccggatcatctcctcggtagcccgttggtgaaccccttccggatcaccatctccccaaatataatccggcaagatcgccttatggcgctcatcgatattatcgcaaacagcctgtcctaccaaatgggtagagatcgcataaagccgtaagtcatatctctttaacagatccttgattccttgataataagccgtatccgtacgtcggacatccacatgatcgggaagtcccaattccacaccgtcgtatccgaattctttcgctttttgacaaactgtttccagtgataaatctccccactggagggtatacaatgttacaggacgtgccatatatagtattatttttagtcgattatttttatccatttattctctgtcgatccggtagctacaatcgtctcgataaaccgcatgccacggacaccatcctctgcggaagggaaatccaaggtctcaggagccggttcctctcccgccagaatcgattgcaaagccaaggcgaaattccgatacaaattagcgaacgcctctatataaccttccggatgcccacccggcgtacgggaattatgagcggcgatacccgacatatatccattggaagtacggacgatctccgccggacgatccggccaacgcataaccatcgtattcggttcttcttgacgccattccaacccacctttctctccatacacacgaatattcaagccattctctacacctacggcgatctggctagcggtcagcacccctttcgcgcctccctcataacggatcaatgccgccccatcatcatccaaaagacgatccggcacgaaggtattcaattcaccgcataattccacggccttcagccctgttatatattccgccagattaaacgcatgagtcccgatatcccccatgcaaccagccttccccgaccgaccgggatccacccgccaagccgcctgcttattaacatcagcgcagtcattatatagccagccttgaggatattccacataaatacggcgtatcttacctaaatcccccctgcgtaccctttcccgagcctccttcaccatcgggtaagcggtataggtatgagtcagcataaacaattttccggtttccttcactttgtctcgtaattgcttcgcctcatccaaggtatatgtcatcggtttatccagtacgacatggaaaccatgttccaacgccatcatggccggaccgaaatgcacatgattcggggtaacgatagacacaaaatccatccgttcgccttcaggcagggcggcctctttctctatcatttcctgataagatgcgtaaatacgattatccggtaaaaataaagattgtccggtagccaatgaattctccgggcgagaactgaagcatccacagaccaactcgatctgtccgtctaaattagcggcgatacgatgaacggccccgataaacgagccttgtcctccaccgaccattcccattctgatttttcgtttcatggtattattccgttttattaaactaaggtaattacattgttgattcacaaagctatgaaaaataaccctgcgtacgccaatttaacagcttaatattttttaattcacaaaatatatcgttcctttgcgtcaaacatttaccaaaaatatcaactatgaagaaaaatgaattagtggctatcgcctgtctgctttgtttttgttgttgtaatggaacggaaaaggaagtacctaaccccgacctacaagaggaattatcccccatacagtttacgatcgatttacaaaaggaagtattacccttccccgtaaccaagagtattcccgagctgaatatccctgagcctattccccaaaatcccgatgccgaggaagatccttctacaccggatatcgatccggataatttatacaaccggatcgattatatcgtataccaaagcggaaaaccggacattctggtaaaacataagcaattcacgcctcaagatccggatttcacgatcatttatgattcactgccctccggcgactatcatatttgtttcctagcccactcagacaagaatatctccgtgtccggacaaaccgcactattcagtaaagtatcagatacgtttcatctttttctagctcaagaagtacaagcgggagaaagaatcattaaggatatcaccttacaaagaatcgtcggtaaaatagagttcatatccaccgatgccgtacctaaagacctaaaaagcttcacgataaatgtctccaattatcaaaacaagattgacttaaccactgggaatggcatttctcaaaacacgccttatacacaaaccgacacttttaacgactctgatatcgggaaaacaaatttctcccattccttcttcacgtttatcccggctccggaattcatgctcaaagcacacctctcggccaaaaatcagataaatgaagtaacccgggaaagagaggttaatgacatcctgcctctcataaatcacattattcgttatactgggattctctacaccccgaaggaatcagacgataccttcacccttgatatattaaacggtggcaaatgggatagccccatcgacaaagatctaaaagattaatacaaaaccggtgtgccaaatttgacacaccggctacctttttcctaaccttcacacttattttgcgtcttctatcttgaagagagcgttaaatcccgtcaaactaaaggtctcacgaaccacattccgcataccgatcaaacgtaaagaccctttcttggcagtcgtcattttttgtaatattaaaaacaatcggaggcccgcactactcacatattccaaatcagaacaatcgacacatacttttactcccggattctcccataccggcaaaaccttttcctcgcattcgcgagccgtattcgtatccaatcttcctttgatcttaattacagtctcttcacctttttggtcaataactacttccatatctttatattttattcggttatttttttcttcatgataaagacattccgctcatctactctctgataagagacctcatccataatcttcttgatcaagaaaatacccaaccctccgattggacggtcttcggcagataaagtaatatcagggtcttttcttaaagtcggatcgaaagcaatcccatgatctatcaaagtcacgatcaattccccaccttccctgaccaacgaaatgtctacggcatcctcaacatctcccttatacgcataaaaaattatatttgagacagcttcttccatcaccagattcaggctcatcatgaaagcggtgcttaatcccaattcttctccagcttcctccaagaactgattcatcatggaaagctcatgaatatcgttcttaatgcgtaatgttttttgcatatatctgaaaattttgcgctaaagatataaaaaaaagaaatatcctttccttaaatttgtatctttacctccgaatcgtatttataaggtatagagttatggctaaaagatatttaataaacatattcttattgatcgccgtcttatgcgggttcagtagttgcgaggaggatccgtattatgatccgtatgaggaaatcacctatgatttatgtaattatgtatggacagattggtttgtcgtagacggcttggattgtgagcagcaacttacatttaatccggatgggaaaggatgggatacaagaatttatcattacccaagcggacgcatagatcgagaggaaattccattctactgggactgggacaattactataccgatatactttatatggactatgaagacggccgaacaacactagagaacgtatggattagtggtcggacttttaaatgtctatataatggcgaatgggtaacatttaaggcctatcaaataggtctctaaaggatatctttacgtacttccccggcaaaatcatacaatccatcaaaaagacagggatctttcctcaattgttcgaacagtcatacaagtagtctcgccgggaatcgaacccggatctaaagtttaggaaacttctattctatccgttgaactacaagaccaactcttttgagattgcaaaagtataatcttttcctcaaataggcaaccgttatcggatgtttttcccgcctatccggaagcttctcattatttccgaaaaaacatgtacgtgtttccggaaaaacatgtacgtctttttcaaaaaacacgtacgtgttttcaagagctaatataacatcaaatagatcaatcaaataagctttgcatcaccgataacgatttgatttccggaaaatccgggagatgtagacggtaatactcaagaatacgatgaataatacgggcccgctcttgccgggaaaaaccataaagcgacatattctcaaaactgatacgcagcaaacgggaaaagaaagcgctctccaccttatttaaataatgccgatgcatcgggatatgatccgtaaacaccccattcaacatatcgaaataatatcccaccctatgcgattccatattcgggaaaataccgagatgatggagaagacctaacaagaaaaccatatgaaaattagcgatacctttatccgcatactccaatagatgtatggactcgtataaataatcaaataaacggggatccggctccgtatctttcacgaccctaaaaagaacctccgagaggaaaagcgccaatacattcttaaccggatcacaacaaacatcattcagcggaaaacaaatgcgggtctccttaatccggtgcaagtcccgcttattcaagtgctccacctccatttccagaacggacaaaggtataaacaaagccttcgataccgtgcttttcttccctcggctacgactaaccagatacgaggcccggccaaacgcctccgtatacatatatataatagaatatttatcattgtaagggatcgtatgcaagacaatccccctcgttttacacaacataattcgtatctttgcgacgatgattaagaacaaagatactcaaattaacgttatacatataattaaagtatagaattatgttggacttaacgaccccttctttattattttccgccatatcattgatattgttggcctatacgaatcgcttcctttcatacgccagcgtagtgcgtgccttgaaagaaaagcatcagcaaacccatgaccccaaggatatcgcccagatagcgaacctgcggaaaaggctctatctgacccgttccatgcaaatattaggaatactcagtttgctgctctgcgtgatcgctatgttcttcatttatgtatcgtggcaggttttcgccgcatggatatttggcatagccttattgctattagcggcgtcgttatgtgtatgtatctgggaaataaatatttccgttaaagccttggaaattcatctggaagatataagttctaaagagaagttaaaacagtgagtagtattaaattttccttcgaaatgttttgccagttcagagagatcgtctatctttgcactcgcaatcgggaaatcactttcttagaacgctataagtgggagctttgacattttggcccattcgtctatcggctaggacgcaagattttcattcttgaaagaggggttcgattcccctatgggctacaataaacaggattaaaaaacaataaagagaagatctagaaatggcaaatcataagtcatcaatcaagagaatcagacagacaaacgcaagacgtttgcgtaacagatattacgcaaagacagctagaaacgctatgaaagttttgcgcgctactgaagacaagaatgaggcacaagctttattccctaaggtatgctctatgttggataagcttgcaaaaaagaacgttatccacaagaacaaggccggtaatctgaaatctaagttggctaagcacgttaatgcgctagcataagcagaaggtaattacttttacaagtataaagccggactctcaataagcccggcttttttaaacctgatggcccattcgtctatcggctaggacgcaagattttcattcttgaaagaggggttcgattcccctatgggctaccaatcaaaaggagagagataagtttatggcttatctctctccttttttactacacccgtccttttttcgctattttcacatcccccacttcgctatctcgataaaaatcactacatttgttagatttttttttgaggacatagataattacagattttaaagaaagataaactcatgagtgaagaaattaagaatacttctacagagtactccgcagatagtattcaagtacttgaagggttagaggcagtacgaaaaaggccatccatgtatattggcgataccagcgagaaaggtctccatcacttagtgtatgaggtcgtagataactccatagacgaagcgctagccggatattgtacatacatcgacgtggtaatcaatgaggacaactcgatcacggttaccgacgacggccgtggtatccccgtggatattcatgagaaagaaggtaaatcagccttggaggtagtactgacagtgctgcacgccggcggtaagttcgacaagggaacctataaagtatccggtggtttgcacggtgtgggtgtatcttgcgtaaacgccctctctacttatctgaaagcggaagttcgcaggaacggcaaagtacatatgcaagagttctcttgcggaaagccgttgcacgacgtacaagttatcgataatacggataaaacaggtactacgatctctttcaagccggacggttctatctttacggtcacggaatacaagtatgatatattggctacccgtttgcgtgaattagcgttcttgaacgcaggtattacgctacgtctgacagataagcgagttctgaaagaagacggttcattcaagtccgaggtattccattcggatgagggattgaaagagtttgtccgctatatcgaccgttctaaagagaaactgattccagacgtaatccatatcgttaccgagaagcagggtatccctgtcgaggtggcgttaacttataatacttcttacaacgagagcgtattctcttacgtaaatgatattaacacgatagaaggtggtacacacttagccggtttccgccggggtctgacccgtacgttgaaaaagtacgccgaggattctaaattattggagaaagccaaggtggagattcaaggggatgacttccgtgaaggtttgaccgccgttatctctatcaaggtagccgagcctcagtttgagggacagacaaagacgaagctgggtaatagcgaggttaccggtgccgtggatatggcgatcggcgaggcgttaggctattatttggaagaacatccgaaagaggcgaaaataatcgtcgacaaggtgatcttggccgctcaagcccgccatgccgctcgtaaggctcgcgaattggtacaacgcaaatctccgctgacaggaggtgggctccccggtaaattggcggactgttcctctaaagacgcagcgatctgcgaattgttccttgtcgagggagactccgcagggggtacggctaagcaaggacgcgaccgtaacttccaagcgatcctaccattgcgcggtaagatattgaacgtggagaaagcgatggatcataagatcttcgaaagcgaggaaatccagaacatctatcgcgcgatgggcgtaaccgtcggtacggaggatgacccgaaagcgttgaacatggagaagctgcgttaccacaaggtgattatcatgaccgatgccgatgtggacggtagccacatcgccacattgatcttgaccttcttcttccgccgtatgcgttccttgatcgagaacggatatgtgtatctggcgactcctcccctctatttgtgtaagaaaggtaaggttgaggaatattgctggaccgagcaacaacgtcagcagttcatcttaaaatatggaggaggcaacgagaactcgatccatacacaacgatacaaaggtttgggagaaatgaacgaccatcaattgtgggatacgaccatgaacccggaaaaccgtacgttaaagcaaatcacgatcgacaacgcagccgaggctgaccaaatcttcgccatgttgatgggtgaagacgtaggccctcgccgcgagtttatcgaggaaaacgctacatatgctaacatagatgcttaaaatcatgaaagtccgtcatccgaatctagaggccctatacaaagaagttgataattatataccggctaaagaaagccttcaacctccccgaataggaatatccgctaaccggagagacggactttcctgtatagccgagacctacgtgcaagccgtgctggatgcggggggagccccggtacttatcccggtgatcacggatctgaaagcattgaccgtactggtttccgaactagacggattagttatgagcgggggtggagacatcaatccgctctatttgcatgaggagcctatcccgcaattgcaagacgtagatacgttacgtgacgaatacgatttgatcttgcttcgcttggccgctaaccgacaaattccgatcatgggtatttgccgggggcatcagatcatgaatgtagcgttcggaggaagtgtctatcaagacatccattcacaagccaatcatgctctattgaaacacagccagacattggctcgggaatatccgtcgcatacggtaacactcgaaccgggaatgaaccgcctacgtactattttcaatggagatgaacaaatccttgtcaactctttccaccatcaagcggtaaaagaggtcgcccccggatttagagcgacagcgaccgccccggatggaatcaatgaggctatggaacatacggagaaaacgatattcggtgtacaatggcatccggaggccatggctccgcaaggggatgaggccatgaaagccctattcgcttaccatatcgagaatgcccgccgtttcgcaaaagccaaagcgatccatcaacggatcgtgacgatcgattcccatacagataccccaatgatctttcccggtgaatttaatatcggggagaaagaaggagggaaagtgaatcttccttttatggaagaagggcgtatcgacgcgacctttatggtcgcctatatcccgcaaggtaaacgagatgaggcatccttacaggcagcgacagcgtatgcgatagaacggctgaatcaagtaaaacgccagcaaaccttacatccggaccggatggttatagcgactaccccccaagagatccggacgattaaggcgcaagggaaaaaagcgatctgcctcggcatcgagaacgggtacgctttagggaagctggtcgaaaacctacgaatgttcaaggagatgggagtttcttatatcaccttatgccataatggggataacgatatttgtgattccgctagaggaaaacaggaatggaaaggactaagtcctttcggtaaggaagtggtaaaagagatgaaccgattaggaatcatggttgatatctcgcatgcggcggaaagtaccttttatcaggtactggaagtgagcgagacgccaatcatagcctcccactcttccgcacgtgcgctttgcgatcatccccgcaatttaacggatgatcaactgaaagcgctggccgctcaagggggtgtcgcccaaatctgcctatacaaaggattcatcaataaggaagaggaaaaagcttctttaagcgacgctatccgccatatcaatcatatcgtggatttaatcggtatcgatcatgtaggaatcggctcggattttgacggagacggggaactgatcggttgctcggctaccaatgagttgattaacattaccgtccgacttttagaagaaggatatacagaagaagatatacggaaaatatggggtgggaacttgctaagggttatgaccgctatacaagattttccaaacaaatagcaaacgaaaacaactacatattatgaaaaatatcttatacacagcaatatgcgcctgtagtatcttatgtggagcacaggcacagacacccggatcggaagtccccaacttaaaaaagctatatgagttgacagactcttgcgatgtaaacgtgcgggcacgattctccccattgatcgggatttccgccagtatctcaagtggtgcttcccgggtaggggccacctatatccaatccatcgtaaaggcagggggaactccgattatcatcccggctgttactgacggtaaagtactcaggaatatcgtatcgaatttagacgggttagttcttataggaggagcggatgtaaaccctctatggtatgaggaggagcctcgggaaaagctggaggaagtcgatccggtacgcgatttgtatgagttgaaactaatcaagatggctaccgaccaaaatattcccgtcttaggcatatgccggggattgcaactgttgaatgtagcgtttggcggtacgctttaccaagacatcccctcacaacgtggcgatcattctgtcaagcataggcaagatttacccagttcgtatggctcacaccgtgtctttgttgacgcgaactcacagctagcctctattctagggaaagataccttagccgtaaactctcttcatcatcaagcgatcaaggagttggcgcctatcttcaaggctaccgcttatgcgcccgacagtattatcgaggctatcgacgcttatccgaatcgatccatcatgggagttcaatggcatccggaagcgttgacttacggaggcgacactacgatgttaaggatattccgccatctgataggaaaggccgagactttccaccaagccaaagagatgcacaagcatttcctttccgtagatacacataccgatactcctttctggttcaaacgtgccggattcagcatcgcggaccgggaacgtaaccgggtaaacatccctaagatgcaagaagggaaactagacggggtgttccttgcggccttcatcggacaaggtaaacgtgatgaggcctctttacaagaagccgtacaaaaagtaacaggcttgatcgaaggtattcgcaagcaagctgaattgaataaggatttatgtggcatcgccgttacgaaccaagacttcatccgcttgaaaaatgaagggaaaaaagcgttctttatcggtatagagaatggatacggcattggtaaggatctggcgaatatcgctaagttcaaggcgatgggtgtcaattatatcacgctctgccactcctacgataacgatatttgcgactcatccacccataccaagaaagaatgggacggtttaagtccgtttggtgaagaggttgtgaaagagatgaatcgccaaggtatcatggtggatatgtctcatgcctctgagaagtcattttgggatgttatcaaattgtccaaggccccgatcatctgctcgcattcctcatccatggcgatgtgcaagcacgaccgtaacctgaccgacgaacaactaaaggcccttgcccaaaatggaggcgtagcgcaagtttgcttgctcgaccgctatatcaatgaggattataaaaacgcgagccttaccgatgcgatcgaacatatcgatcatatggtgaaagtcgccggtatcgatcatgtaggtatcggctctgattttgatggcggtggcggaattatcggttgcgaaagtgacaacgatttcatacagatcactgttaaattaatagagaaaggatatacagaggaagatatcgccaagatatggggtggaaacttgatgcgtgtattagacgaggttcaagcgactgcctccgtaaaaacattataaacaaaacagatttatgatcagattattttttgcgttattgagttttgctcttttatcatgtggagccaaaggaaccaaagagacaggtaatatgccggagatcaaaaaacaaccgatcgcctcagctgttcccgatttcaacgcagacagcgcttacgcctatgtagcgaaccaagtcgcttttggtccccgtgtacctaacacggcggctcataaagcatgcggggattacttagcatctgaattgaagcgctttggcgccaaagtctaccaacaggaagcgatactgaccgcctacgacggaacgaagctggaagcgagaaacatcataggctcgtttgatccggagaatagtaaacgtgttttactattcgcgcattgggacagccgtccctattcggaccacgatcccgatccttccaagcaccggactccattggacggggcggacgatggcggtagcggcgtaggtgccttattggagatcgcccgtcaaatcgggcaaaaagccccgggtatcggcatcgatattattttcttcgacgcggaggattatggtacgccggaattcgtaaccgattatacaccggatagctggtgcctaggtacccagttctgggcaaaaaatccgcatgtccctaattatacggcggaatacggaatcttattggatatggtgggcggcaagaacgccacgtttttcaaggagcaacaatccttacgtgcggcagccccgatcgtcgagatggtatggagcgcggcccgcgatctgggatatggcaaatatttcattaacgccaccggcggagcgctcatagacgatcaccaatatgtgattagcggacgtaatatcccgagtatcgacatcattaactacgaccctgagtctaaaacaggtttcgccagttattggcatactcaaaaagataatatggaaaatatagaccgtgagactctaaaagctgccggtcaaaccgtactggaagtaatatacaatcgataaaatactgataaaatgacaatcaatgaacttcaagacaatgtaatcgaagaattctcagtcttcgatgattggatggataaatatgcgttattaatagatctgggaaactcccttcccccgctcgatgagaaatataaaacggaaagcaacttgatcgagggttgccaaagccgggtttggttccaagcggattatgcagatggaaagattattttccaaggagaaagcgacgccgtgatcgtaaaaggtatcgtatcccttttgatcaatatcctatccggccataccccgcaggagatactggatgccgatctttactttatcgacaaggtaggattaaaagagcatttatcccctactcgttccaacgggttggtagcgatggtgaagcaaatgcgtctgtacgcaatggcttaccgggcaaaggaacaacaataaaaataggtgttttcacacgtatataggcacgagccgatacgtatatacgtgtaagcctacaccgatataggcatagcctcatacgtatatacgcataaggttatgcctatatacgtattaaaaacctagtgtaagctgctccggtaaaagcgtgaatgtcttgcgatgataaggcgtgattccgtgggtacgaatcgcttccctgtggaccttggtaggataacctttattgtccagccaatgataagcggggtattccaaggccaattcattcatataatcatcacgataggttttagccaatatagaggcggcggcgatactcaggtatttgccatcgccttttactacggtcgtatgcggaatatcgggataaggggtaaaacggtttccatcgatcaataaatgttccggccgtactttcagttgctcgatcgcacgatgcatagccaagaaagaagcctttaagatattaatcttatcgatctcttccggactgacgatgcctaccgcccaagcgatcgcctcacgttcgatgacaggacgaagcttataccgtttcttctcgcttaattgcttgctatcgtttaaatcctcattcttaaaatcttccggaagaatcacggcggcggcgaataccgcacccgccaagcagcctcttcccgcctcatcacacccggcctctatacgcccggtttccatatatggtaataacatatcccagtttattatttatcgtatatatagctttgtagagacggagcacgccccgtctctacaaggttgtacattatttttgctcattcacaatccaagggcgaagcacgaaccaagcgaatgccgtagcggcgatcaccccgcaagtattcgccaagaaatcaaaccaatccccaccccggtacgtcgtacaatattcttgcaatatctcaataatcccactcataacgatcgggcataaaactgccccgatccaagcatgccataataccgtctcatacttccggtgattccgcaagaactccagccatagcatacccgacatccccccatacatacagaaatgaaccaccttgtccacacccgggaataaagggatatcatccatcttcggcggcttaaagaacgacaagtaaataacgaccaatataattgccagtgaaaacggatatttcttaatataatacatcatactcaaaacatcttccgaactcgttccacacctgcgatgaacgtatcgatctcctctttcgtattataaaaggagaaagacgcccgcaccgtaccctcgatccctaaggcatgcatcaaaggctgggcacaatgatgccctgtacgaaccgctattcccaaacgatccagcaacatccccatatcgtaatgatggatattacccaccaaaaaagaaagcaccgctcctttatgatccgcttgtccgaaaatacgcatcccttcgatcgtatttaatccagcggtcgcataccgcaaaagctcatcctcataagcagctatattctctataccgatccggtctacataccgcaaggcttccgccaacgccgtgctaccaatataatccggagttcccgcctcaaacttaaagggaagctcattaaaagttgtcttctcgaacgagaccgtagcgatcatctcgcctcctccctgatacggaggaagtttatccaaccactcctctttgccatacaagaccccgatacccgtcggtccgtaaatcttatgaccagagaaaacatagaactccgcatccaagtcctgcacatccaccttcatatgcggaacggcttgagccccgtctaccaacaccggcacgccttgttcatgagcgatctcgatcatcgcctttaccggattcaccgtacccaagacattagacacatgagtcacggaaaccaaacgagtcttatccgagaataatttacgatactcatccagattcaactcccctttctcattcatcgggatcaccttcaacgtaatacctttccgggccgcttgtatctgccaaggaacgatattggaatgatgctccatcacggacacgatcacctcatcccctgccgacatacattcatccgtaaagctggaagcgatcaaattaatggattccgtagttccccgggtaaaaataatctcattcgaggaacgggcattcaagaaatgctgtaccgttttgcgagcctcctcatgcgcctctgtcgccgcttggctcaagaaatgtacgcctcggtggatattagcgtttacgttataatatccattctctatcttttctaccacttgacgaggtttctgggtagtagcaccattatcgaaatatatcagcggtttatcgtatatcttatgatccaagatcggaaagtcttttcggatcgcttgaacgtctaacatagtcttacttctttttgtcttaaaattacgagagccaaagatacaaaaaaaaggctttctcgctgaaagaaagccttttttatcattacctaacagatattacgcctacactttattctcttctcgcacgtttacttttctcttccaaagttaaagtacggagactctatgcgggcgttgtccatcaagactgccagttcttttaccttatcgggatatttctccgccagatttgtatcctcgtgtatatcattacttaaatcatacagttccaatatagtctcacccacgatcggttgccggattagtttccatttaccggagcgtaatgcttcccggccattcaactcgtgaaattcccaatataaataatcatgggtgtgacctgaaaagtcacgtaattgattgttaaacagcaatgtatattacaagatttaacccgctgttccgtcagcggtagcctactataaggtgcatctccagtgatgggttgtgctaagcttataggacaaagtacactttccgaaaggacaagactgaaccgtgagggaacgtcaagggcggttagtatcataccgtcgagtggcgaggctggatagcatggttaacgtaatgtgaactgactttagccgtcgtaaggtttgaaggagcgcaagatactttagctctcaccaaaaggtaagcagtcggataaccctcgcccatgttggggttacacggacatagcactgccggcggacttggcagaacctaaactatccgtttgtcaattgcgtggaacagggcaagcctgtatctctctcgtaataatgcgagtaagcgaaccgcaaggcaagccgaatggggtgcaggtatgagataacgaagaaagcgaatgccgccctgtaatggggaggatacggattgaaccaacatcacgagttaatgagggtaacatcatccgacacgaaagtgggcagacttccgtatatggtaactctttacaagataacttttagaactttcaaaaggaggaaagcaaatgaacgagattaaaacatcgtgtgcgcctgctgacagcaggaatctgacttgggacggtatgaactggtctaagtgtgaaacctatgtccgaaagctacaagcgcgtattgtaaaggctcagaaagaaggcagacataacaaggtgaaaaccttgcagtggatgcttactcactctttttacgccaaggcattggcagtaaagagggttacttccaacaaagggaagaatacgtctggagtagataaacagctttgggactctcccaagcgcaagtacaaagcaatcggtgaacttagacgtcgtggctaccatccacagccgctccgtagggttcacatcaagaaaaagaacggtaaactccgaccgttgggaataccgaccatgaaagacagggcgatgcaagcattatatctcatggcattggaaccgatagccgaaacgacaggcggccgtttttcttacggcttccgaaagaagcgcaggacaatggacgcaattcgtcagattgatacggttctaaatcgccagcattcccccgaatggattttggagggagatattaagggttgcttcgaccacatcagtcacgactggcttattgaaaatatccctatggataaaacaatactcagaaaatggctgaaatgtggagctgtattcaatggtaaactgttcccgacagaagagggtacaccacaaggaggtatcatatcaccgacacttgcaaatatggcacttgacggacttcaaccactcttggctgaaagattcaaaagacgtttcatcaactataagacattccactacaaagtgaatcttatcaggtatgcggacgactttataatcacgggtcgagataaggaattattggaaaacgaggtcaaaccaatggtgatagaatttctcaaagaaaggggtcttaccttatccgaagagaaaactaccattacgaacatatacgatggatttgatttcttaggtttcaatgtaaggaagttcggcaaaaggctgtacacatctccgtccaaagatgcacagaaacgctttagggcaaaaatcagtgacatcgttaaaggacataaaatgtgtaagcaggaatcgctgatacgaatgctcaatcctgtgataacaggttggggaaactattaccgatatggtgcatcaaccaatgcttttcacggttgcgacaatcacatttacaacctcacaaagaaatgggctttacgtcgccacccaaagaaacgcaagtcttgggttgcagataagtattggcatgaaattcgggggcgtaaatggacgtttgcatggaaatatgaaacaaaaagcaagaaagtgaactacctgacccttaaaaggttgtcggatatacattatactccgtacaagcaagtcaagggggaggcaaaccctttcgacccggaatacgatgattatttctttcagcgaaaggagcaacaaatgctggaatctctcaaaggacgtaagtcactcttatatttatggaacaagcagaagcggacttgtccgttatgcggcaaggagatagattgtacaaaagcatggaacgtcaatgaaatatctgttggtggttcaattgtacggcaacttgtccataacaactgctacaagcgaaataaacgaaactgttgaaagtatgagccgatttctaacaacaaatagaaatattgagttgcttgagccgtatgaggggaaactctcacgtacggttcttaggggagaagggggcagtaatgcccttgacttacccgatgcctgttgatctttctttgataacaaggttggtaagaaagagattccatccgtcttctcgggcaaaaccgtacctgtaagttctgccaatgtcggcatgacatcccagaatgcgcttatatgatccgattgggctccggccttgatcgtacccgggcaccatgccaccataggtatacggatgcctccttcatatacatcccgtttgatccccctaaaaggtccgtaactcttgaaaaaatcgggatcagctccaccctcatgatgcgggccgttatcgctggtaaaaatcacgatcgtattcttatccaaacccaactctttcaattcagccattacatcccccacgtatttatccaaccgggagaccatggcggcaaaggaggccaagggcttctccgaggtgttataaccgccatacactttatcaaacttaccaatataaggagtctcctcgaatgagttctcgtacatcttataaatagaatcatgcggaagattcaattccgcatgaggcagcgtataagtaagcatcgcaaagaatggttgctccttatgatcccggatgaacttcaatgcttgctcatgaatcaaatcttgtgaatatgtcttgcaagcattgttctcgttttcaggaaaaagaaccttctcctcattatgccataaatgatccggatagaaggaatgcgactgccgttggcaattatacccataaaactcatcgaagcccatcttattgggaatggagacagagcccggatttcccaatccccatttaccaaagataccggtcgtataaccggccgatttcattaatttacccaacgtataggtatcttcccgcatcggctgttggccttcgggcgtgatctcccggtttccccggacttgcgtatgtcccgtatgcaatccggtcatcaaggagcaacgggaaggggcactcaccgtacatccggcataatgctgcgtgaacaacattccctccttcgccatccgatcgatattgggcgtcttgataatctgctggccataacaacccacatcgccatatcctaaatcatcggcaaggatatataccacgttcataggacgctctggagttttttcgcaaccggacattccgacaagcagcaatgtcccggatatacataaagtcaattgtgttttcatatacgtcataaaataagaatattagaaacctatcatgatcttctgatcctgattcgtagacaagcggttcgtccgtaccttaacccttcccatacgatccgaggcatcgaagtaccagccttcttgtccggcattgaacgcttcgggggagatggcagataggggcttttcggctacggttacgtttgacgggctggattctgagcggacatccaataggtaagtacgctcttggtaacgtcctttataatctcctttcgctttcgctatatccacggtgatcgttcctttctcaccttttggggaggaaacagagattaaggtacgggcaaactcgcctttcttataatcacgggtgagaccgtcatcctcatataaattgaaagaggtgtttccgtagggatataagtccaaggtcaagacatccgcaggtttctcgcctacataattcatatccgggtacatcgggataatggcgccttgacggataaataccgggcaaatatccagtttagcctcatatttatccaaccacttgccaccctcgtatttctttccggtccaatagtcgtaccattctccggcagggaagtagatactgtcgcgtacgttcttccgggtatatacgggggcaaccatcatccactcaccactcatgaactggtattgggtagtcgtatcacgggtaaccacgtcgtccgggaattccaataccatcgcacgagccatcggtacaccggtcatatgcgcctcatggcaataggtataggcgtacgggttcagacgcatcttcagctttaagaatttacggttgatatccgtgtacggatgcccatatacccaaggctgacggtcggcatctgcccagccactcatggtcataaagatcggggtgaagaccttccattgcaagtcgcgggtataggttttcggggaaccgccgaagataccgtccacatcgctagtagcggcgttcatagcggaaaggccggcacccgtgatcgtcgggatatggtaacggatataatcccagttgctcacttggtcaccgctccataccgtagaataccgttgggttccggcccaaccgcaaacagcccatacgaaaccccgttcattcgtattgttctcgatcccctcgaatgcggatttacagccgttcaaggcaaactcatagccttctccaacccaagccacatccaatttacacaggcgggtaccacatttacctacctcgtaggcaatcttatccacaccattctctgtccacaagcccgtatggaaacctcgtttgcctaattccgtcacaacagaatccaatttcacatagccgcaaccatagccatcgttcggcaagatccagccacggggcatatcatattccacatatttatcggcaacttggctgattacgtccggggtggattgaggccatccggtgcgctgttcccctttgttatagcagtcggcgtctcccatcgtaagcatccacatcgccggcataaaaggttttccggtgatatccgtatagtcgttcaataggtctttcaaggaagggccgtagaagtagaacgcgtcaaagcgattctcgttatgcgtcaactgactggtgaagcccatcagcttaaagccatcatcatagttcttgtccaacatctccgtgccgttgaaggcataatgtcccggggcaaacgtattgcggaatacgccatatcctttcgtggacatatagaagggagccgggttagaggattgatcctcatcccaaccggtcacctcgatatccgcttccttcccagcgtatgagaaattaccttgttgcataccgcaaccgtagaaatcctcatcaccgctacggcgcatcgtttgggtcgtttttagtccgaaggcaagtggttcggcctcctcgtagatcacggcacggttattcttgtcatacatggcgaaacgaatagggttcttatagacacgtacgacacattggggagtcgtgaacttataatagctgccgttgtcggccatggagactctcgggttctttaccccataatccacgacgatcgagtttgccgccggattggtatactccccatccggtgccaaccagatacggaagatatcatcccgataaaacatcaacttaaccttagcgtacccggagacgaactcatattccgtgttgctgatcttattgaacttcgtcaacttacccaagttcatacgggcggcgaacaggttcgcttttaatacgttgtttgacgaacgctcatccttcgggtattggatagcgaactctattttataggaacccatctgggttaggtcggtagcggggaaagctacctcatattcctcttgtttagcgatcggatgcccggaggcggttaccgtggcggttagtttctgaccgttgtttaaagaggcggttaccgtgaaatcctcgtctacgggctgggagccaacgttcttcagcttcactttcaacacgtcttccttcgtgaacgtattcccggtttcttggtgtgaggtcactttctccaaagccaaatcatgcgcaaaaggctctgtcagctcaatatcatcgaccatccaataccaagagaagatatcccgccagaagaaacgcaagtagacggttttctggttcgcggctacctcgctgatgttgatctcctcgttcaccggggcatgaagctgggtagcggcggggatcttatccatcacgttatactctttccaattcaccccgtcgttgctgacgcctacccaaaggccggcacgttttccggtgaaccaattattccaacgaaacaggtgctggaatttcaataccacatcgttctttcccgcacaatcgatagcgctggtctggaaatagccgttcgggtattcctcccgttgattccacttcgtgatctcctccccggtgactacgcccggccggaattgcatatgatagccacgactcgtagaggcgatgggaggcgcttgttgctcaaactggaaagaaccgggataaggctgatcggtaacaatccattcacactttgccgatttcgtcgaatcgacaatcatccagccgtcgggtaatttcccggcagagaaatcttctttccaaaaactttgttgtgcggacagggaggaaacgcaacctgtcagaagcatggatacaattagactttttatcatttgaattagttgattagatttaggcagtaaagatagtcttaatttacgagggttcgcaaacgttcgcgtgatttttattcccttttcgccgggcgaaagcgtgttattatcaatggaatccttctatcttcgcgtatgtacaaccttgtcatataaatcaataaacatatatcatgaacagacatttattcttgagccttttactggcccttttcgcttccagtacgctttcagccgataaccttagaatcgagccgaccttctggtggagtggtatgaagaacccggaactccagctgatggtatacggtaaggatatcgccggatatctccctagcgtgaaatatcccggcgtacagttgaaaagctcggtagcgttggaaagcccgaattacctattgatctatctggacgtggaaaacgccaagcccggcaggtttgatatcacgttcacgaaggacaaaaagagtttcaattactcgtatgagttgaaggcccgtaaaccgaacgccgatcggatcaaggggtttgactcttccgacgtgctttatctcatcatgccggatcgtttcgcaaacggagatccctcgaacgatcaaatcccgatgcgtacctcttataaggtagaccgtaacagcccgaacgcccgtcacggaggcgacttggccggtatcgagcagcatttggattatatcgaggatctgggcgttaccgctatctggctgaacccggtattggagaatgacatggagggaggctcttatcacggatatgccacgacggattattaccgggtagacccacgcttcggcacgaacgaggattacgtccgcttgatcgagaagacgcacgagcggggcatgcgtgtcgtaatggatatgatcttcaaccattgtggaagcgatcatccttggatgaaagatatccctagccacgactggtttaataatctcgataactacgtgcagaccaaccacgataaagaggcttatttcgatccttacgtgtcggattatgataaggagacgatgctgaacggctggtttgtcccgagcatgccggacttgaaccaaaagaacccacatgtagccaaataccttatccagaactctatctggtggatcgagtattgcggcgtggatggtatccgtcaagatacgtatccgtatgccgacgtggacatgatgcggaattggtgcacggaggtcatgaacgagtatccggagtataacatcgtaggcgaggcgtggatgaactacacaatcggttccgcttattggcagaaaggcagccggttgaacttcgggcaggataccgagctgaaatcggtaatggatttccgcttgatgggtatcgcgagcaaggcgttccatgaggagactgggtattccggaggcttgcatacgatcttcgagcatatgtgttatgattatgtatatcccgatatctataatgtattgcgtttcttggagaaccatgatacggatcgttttcttccctccatgcctaagtctgtcgatgatttgtacgcgttcaagcaaggggtgacattcttgttgacgatccccggtattccccagctctattacgggcaggagttgttaatgaacggcaccaaggagaagggagacggatatatccgcttggatgttcccggtggctggcccggcgacaaggtgaatcaattcgaggcatccggtcgcagcgaggtgcaaaatgacgcatggaatttcctccggactttattgaaatggcgcaagggcaacgatatcatcgccaagggtaagatgaagcatttcatggtgaaccaaggtgtctatgtttacgagcgcagtctggatggccggagcgtattggtcttgatgaatggcagcgataaggaggtgaacctcccgttggcccgctatgcggaagtattgcgaggtaaaacctccggaaaagagatattaaccggaaaggagattccattgggagacgaattatccttggcaccgaaagggatcttcgtgctggaaatgtgataccattagccccgatgatttttcattcgaggacctatttatagattactaataattaaatcgggaggtctcttaaacctcccgattttcttttcacatatactattttaatctcttttcaagaatcaatcgatgcctgcattgaatgccgttctcccagataggctcggcatagttccgcacgaaataatcacgatctacggctaccaaatcgaagccttcctgttgataaagcatcatcgggccgacggctgaggttccggtacaaatacgcaaaagctcgacatcttgagccggagcccatttatcagatacatgccgtaatagtttccgggcgattcctcgccgacggaagatatccgccacggcaagattcatgatctccgccttaccaccctcctccttgcgaaccacgatcacgccggcaacggaatttcgtaccgtagcgataaagcaatccgaatcctttaggtaaacctctactttctcccgatccggatcggcttccagcagtaactcataaggagggaataaagctgcttgtatctccggctccccgttagcgacgatctctacgatatttccgtcaggatctcggatcacgccctcatagtaaccatccccagaagtgcgggtctcaccggcgatcgtgtatccatccatccggaaacgttcgatcatttgatccacttgctccttcgtatccgcatgaaaagccagatgagccaagccgatatgatccttgtcgtaagcctcattaatatcttgccgttgcatgatctccaaagcggggccactctcaaaagagacgaaataagaggcgaatcctttctttggattcacatatttctcgttactcttaccgttgaaatactttacatagaaatcccgtaaacgttccagatgattcgtccatagggcgatgtgtgttaactgcataagttggaggttttaatttgtcactgccaaagatataaaaaaatcagacatggttccctacatgatcgtcgggataatccatgtctgattactgttttcttcttattcgcgattatttacaaatccggcaaccggcgcatttagccagctcaccgcggaaacgtttctctaccagtttatgcaaacggtctttcaacgcctccaagcgtacatggtcgatcacgtcggaagtgaaagccacgctcaataacatacgggcctcgtcacgtgggataccgcggctttgcatatagaacaaagcgttctcatctaactgaccggtcgtcataccgtgcgagcattttacgtcgtccgcgtaaatctccagttgcggcttgctgtacatacgggcctcacgagtagcgcacagattacggttcgtctggtaagcggcggtcttctgggcatcctctttcaccaagatacgtccgctgaagacacctacggcatgatcattcagtacattcttgaacaactcgttgctggtacaattcggaaccgcatgggtaatatggctataggtatccatctgttgctccttgtccagaacggacataccgcataaggtagactcggcatactcgccattcagttccacgtaataattgttgcgagtcaagccattcgtcaacgtaataccgtttaccaagacattggtcgaggccgcctgccttacgtgtacggaggagaaacgggtcgtggacacactgctttcctccaaatcataataatcgaagcgagcgccttcctctgcgaaaatctcaaccacttgagtcgccaagaatttcacgccgtcgatactatggtcgcaaaccaacaacttcgcctccgaatgaggttccataatcaccaggacacgacggttcgccatcgtatccacatcattacggaatatattcactaattggataggacgctcaaccacgacatttttcggtacatacaccacaaaaccatcttgagccaacatcgtattcaatgcgataataccatccttgctactcggcgccgcctttccgtaatacttggaagcgatctccggatattgctccgtaaaagccttcaaccctccagcatacacgccttccggcaaatgtgctttcggtaagtccttatcgtaaaacgtatcgttcacgacaaagtataacgatgtgctcaagttcggtacgtcacaacggaatacgtcataaggattcaccgggatagcgacccggttgatatttaaaccgtaatccggagcgaacgcttgggctacatccgtatatttataatcctcgcttctcgtggaggggaatccgagtcgctcaaagttcgccaaggcatcagccctaagggcattcatcaccggcgtactatgacgacataccagatcctcacattgggcgaaaagatcgatatattgttgctcggccttcatattactcatctcccatctctttcttgatccagtcgtaacctttctcttccagttccaaggccaattccggaccggcggtcttcacgatacggcctttgtaaagcacatgaaccacatccggcttgatgtaatccagcagacgctgatagtgcgtgattacgatagcggcattctccggagtcctcaactggttcacgccatgcgctacgatacgcaaggcatcgatatccaaaccactatccgtctcatccaagatcgccaatttcggctccagcatcgccatctggaagatctcgttccgctttttctctccaccggagaaaccttcgttcacgctacggctggccagtttattatccagctcgacgatcgcacgtttctcacgcatcaatttcaagaagtccgtagccgaaaccggttccagaccgttatatttacgatgctcgttcaacgccgcacgcataaagttcaccatactgacccccgggatctcgaccggatattggaagctcaagaaaataccctcacggctacgatcctccggagaaagatccagcagattcttaccgttgaagataacctctccttccgttacctcaaaagcgggattacctactaatacactacttaacgtactttttccagaaccgttcggtcccatgatagcatgtacctcacccgctttcaccgacaggttgatacctttcaatatctctttgccatttacgttggcatgtaaattcttaacctctaacatcttttcttattgaaaattgaaagttgaaaattgaaaattattctatcctacgctgccttccagcgagatcgttagtaatttctgagcctcgacagcaaactccatcggtaacttattcattacctcgcgggcatatccattcacgatcaaaccaacagcctcttctaccgagataccccgttgctggcagtagaacaattgctcctcactgatcttactcgtcgtagcctcatgctccacgatcgccgtctcattctgaatatcagcgtaagggaacgtatgagctccacaagtagagcttagtaacaaactatcgcattggctatggtttcgggcgccttccgcacgggcggacaccttcaccaatccccgatagctattctggctatgaccggcagagatacccttggatacgatcgtacttttcgtattcttacccagatggatcatcttcgtacccgtatcggcctgttggtaattattggttacggcaaccgagtaaaactcacctaccgagttatcacccgccaagatacagctcggatatttccaagtgatcgccgaaccggtctctacttgcgtccaagagatcttgctaccctcacctttgcacaaacctcgtttcgtcacgaagttatagataccgcctttaccttccttatcacccggataccagttctgtacggtagaatacttcacctcggcacgctcgttcgccacgatctccacgatagcggcatgcaattggttctcgtcacgcatcggtgccgtacatccttccaaataacttacatacgcctcatcgtctgcgacaatcaaggtacgctcgaactgtccggtattagcggcattgatacggaaatacgtactcaactccatcgggcaacgtacgcccttcggtatataaacaaacgaaccatccgagaacacggccgaattcaaggcggcgaagaaattatcacgataaccaaccacgctgcccaaatacttctgcaccaagtccggatgatgttgtacagcctcgctgaacgaacagaaaataatccccttctccgcgagattctccttgaaagtagtcttcacggaaacactatccatcacggcgtctaccgccattccgcttaaatgcttctgttcttccaaaggaatacccagtttatcgaatgttttcaacaactcaggatctacctcatccaagctctttggtccctcttttttcttaggggcggcataatagataatgtcctgataatcgatcggcgggatattcaagtgaggccatgtaggcatctccaacgtctgccaatggcgaaaagccttcaaacggaactcgagtaaccattccggctcgttcttcttggcagagataatacggaccgtctcctcgtctaatccacgatggatcacctccgtatcaatatcggtaacgaagccatatttataatctccgctcgttacctcattaatgatatgatttgaatcctgcataattataaattaaccattgataaaagcccttcattctactaatgaaaacaaattatgtgggaaaattgttggtactatttgcttcacgctataataaaaacgagattctatcttcgattggcgatgaatcaagaccgatccgcgatccacgaactccagcgcattcaacagcaaactggtaaagaccaaaacgaccagcaacccgaaaaaacccccaaacaaatggttgataacgctcaacggtgtcgcccctaccaccttggtaaccagttcacccgctaggataaatacccccataatcaagataaaacccgctatataactcaagatcgtaaccccttcttccggaaaccaacccaacgccaagatatatcctttcagccaagccgccgctttcccgcagaaaaagatcgcgatcactagggctataagcgaaacaacctgtttgatgattccatcaaacaggcctttcacaaatcctatccctgccagacatagcaatgtaatgtccaaccagttcatcgttataacgtcttctttatttctgtctcttcgtaagcctcgatcatatcgcccacttggatatcgttgaagttcgtaatattcaaaccgcaatccaagccagccacgacctctttcgcatcgtccttgaaacgtttcaaagaacctagctcaccggcatagataacgataccgtcacgtatcaaacgaatcttgttcgtacgtttgatcttgccttccttaaccatacatccggcaaccgtaccgaccttggtgatcttgaatacctgctgaacttccacataagcggtaatctcctccttgatctccggagaaagcatgccttccatagcgctcttcacctcctcgatcgcatcgtagatgatagaatacaaacggatctccacaccttccttctcggcgtttctacgtgcttgcaaagacggacgaacttggaatccgataatgatagcgttcgaagccgctgccaaaaccacatccgactcggaaatctggccaaccgccttgtgaattacgtttacctgaatctcctcggtagacaaacggatcaaggagtcggacaaagcctctacggaaccatccacatcacccttcacgatcacgttcaactcttggaagttacccacggcgatacgacgtccgatatcatccaaagtaagcatcttctgcgtacgaagacctaactcacgctgcaattgctcacgacggttagcgatctcacgcgcctcttgctcagtctccaatacattaaatgtatcaccggcctgaggagcaccattcaaaccgaggatcaataccggctcggaaggaccggccttctccacccgttgattacgctcgttgaacatcgccttgatacgtccttgatgagttcccgccaaaacgatatctcccatcttcaacgtaccgttctccaccaatatggtagatacatagccacgtcccttgtccaaagaagactcgatgatagaaccaaccgcacgttttttcggattcgctttcaaatccaacaggtcggcctccaacaagaccttctccaacaactcctcgacaccgatacctttcttagcggagatctcctgactctggtacttacccccccagtcttccaccaagtaattcatattcgccaactcctccttgatcttctcaggattagcatgtggcttatcgattttattaatagcgaaaacaataggaacaccggcagccgaagcgtgattaatcgcctcgatcgtctgaggcatcacgttatcatcagcggccacgataataatcgcgatatccgtcacctttgcgccacgggcacgcatagcggtaaacgcctcatgacccggagtatccaagaacgtgatacggcggccattctgcaacttcacgttgtaggctccgatatgctgcgtgataccaccggcctcaccggcgattacgttcgcgctacggatattatccaataaagaagtcttaccatggtcaacgtgtcccatcaccgttacgataggcggacgggctacccaatcctcctcgttatcatcttcctcatcagcgttgatcgcctcgacaacatccgcgcttacatattcagtcttataaccgaactcctcagccacaatattgatcgtctccgcatccaagcgctgattgatcgaaaccataaggccgatgctcatgcaagtaccgataacctccgttacagatacgtccatcatgttcgccaagtcgttggccgtaacgaactcggtcagcttcaataccttgctttccagttcttcctgttccatcaactcgtgctcacgtttcacagcggcgtcacgtttatcacgacggtatttagcccccttattattcttattattcttgttggtcaagcgagccaaagtctccttgatctgcttttgaacatcctcttcactaacttccgctttcaccggcttcttcaagcgaggcttacggtcgttattcggacgatcgtcacgattcgggcgcggataattcgtacccggcgtattattcacgtctacccgatctttcttgatacgtttacgcttcttcttagcgtcaccttcctcacccggtttagcaggagcgttcggtttaatcaaagtcggcgaattcggactcttatgaggagcgcccggaccgttgctattattacccggccgattgttattaaacttttgcttctcatcacgctctttccgcttctcctccttcgttttctttttcggacgagtcgattggttaagcgcatccaagtcaatcttaccggttaccttgatctttgactccaatttaaccgagttcaaacggaaaagattatcatccttttcctcgatcttctctacttcctgttccggtttcacactttccaccttaggttccgcaacaaccggttgcttctctacggttttttctttttccacttccactactataactttttcttcttttttctccgtgggagcctgcgcaggctgcgcgggtttaacaggagcttgagcagcgggagcggcaggcgcttccttcactttcggctcttcctttaccttaggctcttctttcaccttcggctcctctttagccttcggctcttcctgctgttttttatgttgtccaccatccaaatcgatatgacccttcattacgatcttaggtctgaattcttccggtatcactgtctttatttccgcggtcttctcttctttcacagaaggaacctctttccgcacacgatccgccgcaaaattacgatctttctctggcagatcctttccaaactcttttacgagcaaagcatactgttcatcactgatcctcgtgttgggattatcctcaaccgagaacccattccggtgcaggaactcaaccaccgtgttgattcccacgttcaattttctctgtacttgaattaattttataggcatatctaactttgtcgtaatacttattcgttaccttcatcttcaaattccgcagataagatagctaaaagatcgtccacggtctgttcttccagatcggcacgttcaataatctcattgcggtccatagcaaggacactcttcgccgtatagcatcctatattcttcagtgcgtcgatcacccagctgtcgatctcgtcggagaactcatccaagtagatatcctcctcgtccgctccttcgatatcacggaatacgtcaatcgtatactcagtcaacatacaagccaacttaatattcagaccgcccttaccgatcgctaaagaaacctcctccggacgtagataaacctcagctttcttttcctcctcattcacacggatagaagagatcttagccgggcttaaggcacgctggataaacaaagagagatttgaggtgtaattaatcacatcaatgttctcgtttctcaactcgcgaacgattccgtggatacgagagcctttcatacctacgcaagcgcctaccggatcaatacggtcatcgtatgactcgacagccaccttggcacgctctcccgggatgcgggcgatcgccttgatcgtaatcaagccgtcattaatctccggaacctccaactcaaacaaccgttgcaagaagaccttatccgtacgggaaagaaggatcttcgggttgttattatagttatccacacgttgaacgatcgcacgtacggtctctcccttacgatagaaatcggtcgggatttgctcggatttcggcagtagcaactcattaccatcgtcatccaacaacaggatttctttcttccacacctgataaacctcagcggcgatgatgtggccgattttatccttatacttagcgtacaagctgtctttctgcaattcaagtatctttgaagccaaagtttggcgcaagtttaagatcgcacggcgtccgaagtctgcaaaatgcacctcgtcggtcacttcctcgcccacctcacagtcggcatcgattttacgggcctccgtcaacgtaagctgcaagttctcatcctccaattcatcatcagccacaaccgtacggtttctccagatctcgaaatcacctttctcagggttgataatcacgtcatagttctcatccgtgccaaacatcttggcgatcacgttacggaacgaatcttccaaaacgctaatcatcgtatctttatcgatattcttcaactccttgaactccgcaagggtgtcaatcatactgattgtttcctctttcttggccataatcttacttgaatcttattaagtattttgtatattttatttcatcaaatgtatacgactcatcctccaccacagtcaccttccgcttagcgccttccggtttcaccttcttctcgacagagacaaccacaccgttctcgtcggcagatttcaacacaccggtcagcttcgagccgtttttcaacagcatctccacctcgtttccgatgttcttgacgtattggcgaagtaccttgaaaggagaagtaatgccggcggagccaacctccagctcataatcctcgacgtcacgatccagatgctcctccaaataccggctcaactcagcgcaatcatcaatgcttaccgcttcatcgttatcaatttcaacgactatcaggtttcccggtttaatcaccacgtctactaaataattgcttgaagaggctagtttttcctctattaattggcttaccactttcttttctatcatacacatatctgttaagaacaaaagaaggggactacccgccccctcctcaacttcacttaatcgcccgcaaatatacaaaaaatcaatgagttctcaaaatatcctcatctttttacagaaaaaattaatacgacacaaaccggattactatccatagtaatcagaattaatatctatagaaatccgatttactattgacagtaatatttattaacacttttatgcctatctttgctgccgaatacgaaggggtgctcgcaaaatccttcacgaaaggagcgggctgagatcatacccatagaacctgtacaggtaatgctgtcgtagggattcatgcttctccgatcctttctattcatctatttagttttaaagcaaaaagatgaaaagatgaaaaatgtattggttatcttggccggctccttactggctacaaccgtcaaggcacaaatgcccagtccggtcgactccttgaaaatctcaaaagacgtatctttggatgaagtagttattaccgctaccaaagtcgggaaagaaaccccggtagcttatagcgacatctccaaacaagagctaagcagccggaacaacgggcaaggtatcccattccttatctcccaatccccgtctgttatcatgacctcggatgccggaacaggtataggttactccggttttcgtatccggggtacagacgcgaaccgtatcaatatcacgatcaatggcgtaccggttaatgactccgagtctcataccgtattctgggctaatatggccgatatagcctcctcggtagaatcgatccagatccaacgaggtgccggaacctctacgaacggagccgcggcttttggcgctacggtcgccatgcagaccgagaaaccgtccttaaagccttacggcgaatattccgtatcagcaggttctttcggtacgctgaagcatacggtaaaaggcggtaccggattactttacgatcatttcgctttcgacgtccgctactccaatatccgtagcgacggctttatcgatcgtgcctccgcccgtatgagctcttactatgcctccgccgctttctatgccgataatacattgattaaattccaagccttcgggaacagcgagaagacctatcaagcatggaacggtgttccgtcttatttacttgacacagatcgtagctataatccatgcggagaatatgaggaagatggagtgaagaagttttataacaatcagacggataattattggcaacacaactaccatttaatggccagccagcgtatcggagatttctggaatatgaacctgacccttcattacaccgatggtaacggatattacgaggattataaatcgaaagccaaattcagcagttataaactaccggaatatatcgatccggagggtaataccgtaaaaaagacggaccttgtgcgccgtaaatggctcgacaattatttctatggagccgtttatagcgcgaactatcaacatgacaacacccgccttacgctgggaaccgccgtcaacaactatgtaggcgaccattttggccgggtaatgtggaccaaaagcgcaaacgtcttgccacaaccggattacgaatattaccgcaataccggtaagaaattagactacaacgcatacgcaaaattgacccaacgtctttcccctcttttcaccggctatctggacttacaataccgtgggatccattacaccattaagggaaacgatgacaaagccgaggaagagctggacattcataagaactggaacttcttcaacccgaaagccggtataaacttccataacaacggccataacgcattcgtctctttctccgtcgcaaaccgggaaccgaaccgtgacaatttcacggaggcaggccccgaagaacgtcctacccacgagaccttatatgattacgaggccggttatagttttggtaacaaccgtttccgggttggagccaatctctatttcatggattacaacaaccaattgatcctgaccggcaagatcagcgagatcggtgaggccctcacttccaatataaaggatagctaccgaatgggcatcgagcttaccggaggtgtacaaatcacctcttggctgaattggaacgcgaacgtaaccctcagccaaaataaaatcaagcatttcgtggaatacgtggataactgggataccggagtacaagagatcaacgatctaggtacaacgaatatcgctttctccccagacctaatcgcaaacagcatgttcgatttcgcttacaaaggatttatcgctagtttcaactcgcaagtagtaggccgccaatacatagacaattcaagcagcaaggatcgttccatcgatccctactttatcaatagcctacgtatcggttacgccttccagcctaagttcatgaaagaaataaccctagacgtgactatcaacaacctcttcaacgagaagtacgagaccaacgcatgggtatactcttatatcgaaaacgacacacgtaaaaaggatgacggttatttcacccaagccggcacgaacgccatggccaggatcaccttcaaattctaacttaattttcaattactaaaatggtttggctagaatacttcggagtaataaccggtctactctatctctttctagagattaaacaacataaggccatgtgggtggtgggattcctcacctccctcgtgtatgtatttgtcttcctgtccgctaagatctatgcggacatgggattgcaaacctattacgtaggaatcagcatatacggtttctatcaatggacccggaagaaacatgagatacacacggaaaacgacagtcttccctccgactgtatcctatacacccatctgagccttccgcttttcgtggggattatcggaacattggccgttgtattcgccatcttatggtatctccttcatcaattcacggactctcccatccccgtaggcgatgcgttcaccacgtcggtaggcattgtcgctacttggatgctggcaaggcgaattatcgagcattggattttttgggtaatcgtaaacctcgtttccgtatatctttattaccttcggggcttgtatccgacgatgctactctatttttgctatgcgacactagccatagtaggctattacaattggcggaagaaaggggaagagttttgaattatgaattttgaattatgggagataatatggaaagtctggaaggaggatgtgtgatcgtagcgaatgggagatttccttccgctgagttacccttgagattattaaaggaagcgaaaacgattatcgcttgtgatggagccgtaaagacactttatgaaaagggtattcatccggacgctatcgtaggagacttggacagcatacccgccggcctgcgcgaacgctacgcagaccgaatccatcatgtagaggaccaagagatcaacgacctcaccaaatccgtccgtttcgcccatacccaaggctatcgagaagttcttatattaggtgctaccggattgcgtgaggatcatacattgggaaatatatcccttcttatggactatgcccacttattcaagcgggtggagatgttatccgactatggccttttcactcctatcttagaaacaacaaccttcgcttcttatccgggacaacaaatctccattttcgttctttatcccgaaggggagattagtacggaaggactccattggcccattcgccgacgaaagctcacctcatggtggcaaggaactctcaacgaggctttgggagaccaattcactgtcactctctccccggattgccgggtaatcatttacagggaggcatcccatacaaaagaatagtcctgaaaagtatcactactttccaggacccttacacccctcaactttacatgcttaaataagaagcgttcgcttccttatcaagcagataatttttttaactcattctctttccattcggaaaaaccttctaccctatcccttatctggaactgtagcttatcgtcggcaaccaacttcagcacagccgtgggagaaagcggcaaatacatatcattcacggcgaaaaaagctttcagtaagaccacatcatagtcgctgcggatcacttctttctttaatacaaccggtacctccatctgagtcagataataggctgaacgttcgtatgcgcaccaagcatctccttccagatacagatagacactgtttggattatctacctcatgaggcagaaccaactctactacatctgatgcttgttccatataaaagaaattattattaatatttgtcttcatgacatttacaaattaagtgccttctgccctatacctagggaggaatagctatcattttacagcgttgaaactatcaaataccgcattatcctctattttcttgcgcaattcctctaaatttatcgccgcggcctttacacccatatcctgagcctgcttcaatagggtctccgcttctgccaaatcaccggtcaacatacttaacactccttttgcgtgaaccgcctctggggcgttccccgctttcgccaaatagttcttagcggaagcataatcacccttgcccatagcgatattcgcagcgttaagattcgctaccggatcattcgggaacatacggacagcgatatcaaatacattattatattcgtcactaccgatctcatagctgttagccaccgcgaacatctcccctaaacttagctgttgcggacgagtcttgataatctcacgcccctcatccaccgtaaactcacgtaccgtataatcaatcttatattccgaacgacgtaacgaagggaaaatatctttcaacacataacggaaagcggcgccaccacccaaggcacgtaacttagcctccttgcgatccggatcatccgagctatcgataatcgccaatacctcgctacgattcggcacattcggatcggcctctaccttttccttaaaaccgacccaatcttccggttccgagctcatcgtgaagaaatcagccttgaagtcattcttctggcggatatagtcacgtaacgctttgacacgattatccgccaatttcttattactagcgtaagagccttccggtgaggcatatcctttcagtacgatacctgtcggtttcacgttcttatcctctgtaacggtacggatcgtattattgatcttcgccaactccaccgcattattacggaaatcaggaagaatctgatatttacccacttggaagtccaagaaagccgtaccgacttccgcacgatgcttctccgtctctgccatcggcgtgatataagagaatgtaggctgaacctcatagcgcttatccggacgacgacgaatcttgtccgcgatcaataacggactaccggcctcttccttaccgcaaccgcatagattcgggtctaatacgacacgtgcgtctttcatccaatcctcaaaaggcacggcggttttataacttaccacttgatcttccttcccggctttcaagatagtataatgaggtacgtcgttcaaattatccaaggcgacctcacggttatatactttctggcggatacgtccgttcaccaaaatagaaggaagcccctctttttgcgaagccgattccaagacgggggtcagttccaaatagctacgggatttcaccgcatcgctacttaccgtcaccacggcatcgatatataccgagtcacccttctgtaccacgtcgttacaaatcactttaaccccatccgaggcagtctgtcccatgattgccggagacacgacggccatcatagccgccatcatatatgcatttatcttcttgttcatcgcttgggtcatttaataaagtaaataatagaaatagcggctttcgtaaccccgaaataatctttcgtatcgcttttcaatacggttccgcaagtggcacaaggatatttatcataatccagatgcgcccaaccaatacccaacacggcttccatgctccaccgatcgcttaacaaccactgataaccataagagagtccggcgccatacaaattaccttgataacggtgattctccatattcttgctcaagaactttaggcctccaacattgtaatccgcataatgcgcatgcaagccgaagaaatgtccattaaacttctcacacaaccaataacgagcttctggttgtaccagccaatgtttcatacgagcctcatcaccaaacttccatccattatagttgccggatagatccagcgaccactttttcgccaagccaacctctacacccaaattgatcgtagcagtcgcatcatagagcaagttcgacttcaccgcgaacttctggccgtaaacgcctgtcgtagctaccaagagcaggactaggaaaagaattctcttcatatcgaatattttttcgtttttattatacatacgtgaatgccttcacttcgacgagctcgcattcaactgtttaagtaataatttaccgggcttaaacttcacgcttttacgagctcttatcatataagccaccccattcttaggatttctgccgatccgttcggtttgttcccaagcggagagcgttccaaagcccaatagcatcaaagaaccatcactttccaaagcctctgtcgtagtctcttcccaagcttgaacaaagcgcatcgcctccgcttgcgtaaccgacaatttatcagccaatgttttcacgagttctctcctattcatccctttcacttttaatttgcatcacaaaaatagattataacaattcttagcacgataggtgtgagtttcaactttaaagggtaaacctaccaactatccttgattgataagaacacctattcatttcaaagaaggtgataggaacaccgatactttataaagacagcaaggggcagacttgtgtaagcctgccccttagctgttataccatatcatccacatctaacacttaatctcttccttgcgaatgagattctccagatcgtttatctcctccaaggaaagccccgtacattgggcgatcacagagggatccaagccgattctctttaagttccaagcagtacgtaaagcggtcaagcggctacctttcgcctcagcattctccaccgcatactccatcgtagccttccaatcccgatagatcttcaagttctcgtcgtagatggcacgctcctgcggggtgagggcacccaagttcgccacgtccagcaaacggcggaagtgggcctctttctcctttaatggggacatatcaaacaggttcatatttttcagtacataaattgttttttctaacggagtaacgcactcctcgtaacgcaaatcgaatcgctcgaaagagatatagatctgtttcagccggatccgcccaaaagtcttacctgtttgctcgtttgccagaaccacgtccgttcgccatgaagggaactcgggaaggctgaagttcagaaaacgtatctatgtcgtaaaggtaaggactattttccgaataaaaaatctcgtctagataaaataagccattcatatcactttagcatcaaagatcaaccggttagccaaacggacattatctgatccttttgatcaacataagacgtatatcgtgacattcccttttaatgaaagccacacaataaaggcatggagcgccgctttattcatgttttaggataaaaaaggacggttttcaacgcacattaggaggcaaaagcctacacatacggtggcgttgggcaacaccaaccgtgctgttgggcatcgtaagcagttgcgaatagggttataagcggttgcgaatgggcattcttgcactgttacaccccaatcgtaagccttgtttttctccttttcaccctacttgatatgaattacgatgaactaatttagctaggacgaaagggcatttttcagcatctacgtatatgataagcaattactgtttttttcttacgtatttggagacaagccgtaggttgggacgaaaaaagggattctccgggagttaaggatacaaagtgtcaaattgatttctgttaaatagagagagacgcagcacgctgcgtctctacaactagatatattaaagaatagtttttcgtatgaattgattctatttgtagttatcttttatacaacggatataacctctatcgccatctttcttcactaaagaaacagctcctcctgcacgcaatttataagcatgttctccggatttaccaccttgggctataccactatatgaagtacgagctaaaatcacgttagcttttaagtctttaaaaaatcctttgtcatatatagatgaatatgcactcgcatcagttccaaccagataaataacagataattccacttgatttggcatatgccagcccttctcacccataagtttttcacacggatttttaagcttcgtgcgattgttccagttataacctgtctgcgacaaagcccctctaacaatactaaaagacttataaaccctgtttatatcattatcacgttcattatgtggatccaattctcctctagaaggagcgggctttaatgaatttacattcatatagtcaaacgtcacggtaacagtagcatcatcagcagaagatatgctgaaaagcgtcttaggtgcctttacagcctctaaattagtcttatcctccccttttttattcaaatcacgtacacaacgataatttcgaacacttcccaacgtatgtccatcatcatcaccacctattgtaattccttcttccgcccaaaagacagtttttccagttctatcactgggtacataatgatattcaggtgggatgttagtcgtaaaatcttcacttttccaatctcctatattaaaaagagaagactcctcagataaagaggaacgccccaaccataacgagatatattgcccggaagaagctagataccatttcgtttccgtttgatcgatcttaccatctccattctcatctctatttctttgtaaacaggcataatacgcatttccagtaccagtaccggtaatgatctggctagagttactttcttttgaataatctaaaaaagtactccaattcccattatttaactttggcggtagatttaaacggccataagacatatccttaattttacttggattacttgaagtactaaacaaccccgtctcgtttacggtctcaataccccaagcattataatctatccctttatttaaatcgtacaccgtctggatagaacgctgtctgatcacgaacaaggcatccgaagtaagggtactatttcctcctgatgtctgttcctgtgttttatccataataaaaaattcacgatcaagggtattcacgaatttaggccactctatgctttgataataatactcattcacaaaacaaacaaattcaataaaatcctcgttcgttggagatagagcagagttttccccctttgcccatttatttaactctctcaataattcttcaacacctagcaccccctccccattcgcaggatacttatagtattcttttgcaggtacatccttaagcgatttaaaagaaacccaattttttgattcttcattttttaaatctttaaactctgtcaattggaaatcagttaaaggatcttttacataagcttttaaatccgtagtcttaaaatctgttttactgaaccggatttttcttacctcaaaatgagcgtctaatagcattgatcttccttctcccgaaatcgtaacatctccttcttgccgccaaacattactattatcagcagtaacttccgtcattatactgttaacccctcttacctcgatattgtatgtataattcgtattacgattggttgagaaatctgtatgatcaaccccatcgccactccccgctcctaaacctaaatggacgcaatatacaacctccgcactggtttctttcccatcaccctctttttcgtaataagaaccttttagcaacacatacgtagcaggcttatcaacatatgtgaattctcgttgttctggagttgagtgtcttaaagaacccttcgatagttgttctcgggcatccgcggtattacagccctcttttcctgtagctatattttcaggcatatagaaaacgactacacctatatctttggatatggtcagttccggtgttgaataactacccatcgcccctaaggtagcattttcccatacgcttacctgcttaggaacttcacaaacttggtaactattcaaatggaactcccgtccctctgccaccgtaatcttaaagctcaccttggccgctactcgctttaagataattcggcctttctctactaacgtcccgtcctctttgaccgtacaataatcttgtgtatcatcatcctttttccataatccactcaccaatgaagtcgtattcgcgaactggaccgcattatcacctccaatatccgctaaaagggatttcaactccgattttgagggattctttgtcaaccactcctccaattgttccgaaagtcccggaaacatatcatagttcacattcgctatcgcaaaaatctgttgctctccagacagagtagagaaagatatagtagttccagaaaggtccttatacttttgagcggctaaaaactcatcagtactctttttaaaagaaaacacatataaatcagaaacatcactatccaaaaaagacttcgtctcaatctgatcactaatacccgcccccacagataatttcactactgtaggaataccttctttcacttctgttctttgagtcaaatactcatcattcgcacaagcacccaagatcaacagtcctaataaaaaaataatatatcgtttcatcatcttgttttttttagcaattagacatccattctattattcaaaagggtcaagtgtgacttccttgtcttcaacattttctaaaacccattctatttccgtagaagattttaaaccttttatcctatagtagttaccctttataaatttattggcaggaaaagggtattcctttggctctactccgctttgcacactcaatataacctctttaaacgcatcactaatttcatacgtataaaacgtaactggcttagtcgtaggataagccaaatccgagaaagctccattctctacagcagacgtattaaaaatagtgatcttcgaactagcatttaagccagccactttcgttaatgagaatccttctagtaactcaccgttctctttcttataaacccccgtatattctattttagcgctaagctgaatcaatgagactgttacaggcgcattatcctgattatattttaaggtagtttccgatttcccgattttcaccaatagggaagctgtaacaggtccttttgctattgtttttgccgtataactattatccacaccatcataggtggttaagttatcaaatggcgaattattcgcattattcgcattcgccacgaccaacaccgatacctttttgtcctccttaccgaaggtacgtacaccctccaattgtaattcatagccggatagattaccgatagttttcatttctcccaaatcctttgaatagaaattcttaaaatagatacgtttaccatccttatcgaaaacagccacatgacaattctgaatcgtaagctcctccgttgtggcatatgtgtaattaggatccgatgcttttgtctgcatatcccccgtcaataaaaccaaagacatatcaaaagacagctcatccgtatcaaaaccgatcggtacctcagaggaacaagtggacaaccctcccaatagggccactatcaacataaataaaactacattaaatctcataactctatatttttatttattaccctattattccttagaatgtaaactctagctcatgatctttattaaacacccaatcctgtgtcacacatttcacagttacatcgacagcagcattcgtaagcttcaccgtcaacttatacagataaccggcccatacttctgccttaggatcagaagcctcactcaaacgggattttatcgggaaactacaacttcctatttctccattattatatacataatcaatcttcaatgttgttggctgactagatgaggtattttcatagctatacaaacgttctgtagtgccattaacggattgcattccgtataatttctcaccagaagaaacctcacccgctacttgacctatagtcttagaattcagcaaagataaacctttgatttccacattatcatactcagtcccatcagactttagaatcttaaactgctgcaacatgatagccgccgtacgttggataagttttacctcgacaggcgtattagcgggttgatccaaacccagaatcttctcggatatgttcacgtagacacctcctttattatccgggtaggttcctccatctccctttgctatttcagtttcccctacttttacaaaaacattaggaacctcaaccaaggtcttaccctttaaatccgcataagaaatctggctagctgaagctaagccagatctggatacggacgctgccgcattcgcgattaccacgatcttgagatccgtacgctctgatttatcttttggaatcttaaaaattagggattcgcttatcgatccgttcgaggaataataagaagttaaaaagtcccctacattcttagtcttggaatcatacttaaagatagcgatgtaacaatcagaaacagatctctcatccttcgtcatattctcctcagttccgtcagttggcccagtaagttcagagcttttcgtagtaacattcgaattccttacaaggagagagagatctaatgaggcataaagctctgtggcatcgatccctgcaggtcctttcgtatccacaccactcaaaatatcgtcttccatggagcaagacactccgatgcaaaggaagcataataatgctagtatattctttattttcataatggattgaatttttctcttgttttacactagcaaaattagaggaatccattattcggcacgataggcgtaactttcaactttaaggggtaaaactagcatattgaatataggcatttgagggtgtggctaaagctatcttaggcgatagggatacctatgcagggcgcaaatccatccatcataggacaaaaaacggagtccggaaattccgaaccccgttctcgctattaatcgttatgaaagagttttatcaattcacgtctgtctcagtttgcgtgatgagtgtccaaggctcaaccttaatgctaaaactgatacaagcgttcaactcgcttgtgtcgggatccttagagccttcaccggttatcgtagcgtatatcttatagatggtattacgttgtacaccaataatgccactagtcgcatcttgcttaattggtatacggtagtagcgatctcttttaaccatatcattaccgagtccttccgtttttccatttggataccaattgccccgaagaattaacatggtctgtatcattccagatagagaatcaccgttattcggatcatctgcaaacatctgtttattccccctcatttcaaacacataaaattgaggcatctctttatgtccatattcatcaccactaaccgtttgatcatcaaaagagaaccaactgtcaccattataatttatggaaccatcgccgttcaaattagaagaatgactatgacccgtcattttgatgtctacccctccatccattgtccaatgtaaagaagctacatcattcttacctttcactaagaaatagtcatcccgcttatagctacaaccatgagaatatgtggtagcattgtccaaactatacggttttgcgtcagcatagataagagaagtattgctagcgttcgcaatatatacatgtgtcaactcaaatgacgcatcagcataattgttcttgaagtcgcaatcaatagcttgaagttggacacgggctacatggcgggttaatgggattttatcagcagctagaatatttgccggatcataagaggaaccattttcagtccattctgccgcttcactttttttctcaatctcattatgtgctgcacctactgtcgcattgtttgtatatataatagaaggggccgtagatcctttcacccagttatcatactttgtcccagcaagcaactgatgctcacctccaccaatcgtaactatctggctgaacatcggcacatacgtttgcgtaacacctggcgctggatgcacatgcgtaaaatcaacgagatcttcaagttcggcagttttcacatcccccaaattagaaggaggcgtagcaagtttcgtattcgctaaaaagaccaccgccaattgcgtatcagaaagttcgccggccgccgtagcttttaccttaacgacaatatcttcaatagtctttacggaattaccatcagtagaggataccgtcttcattgcggcgaatttgtatgcatcctcgttctccccattgtctacataaaacaaataggcggttagttcattaataaattgctcgttattactgccagattctagcacagcatcaccgccctctttcgttgcaccttttgtctgtatcccatccaaagccgtagcggtaagagagacattcgcatctatcatctgatagttctcttccggtatctcgatgccattcgagctatcgtccgagcaggaggcaaaagtgcatgcggcgaaagaggctaataataaatgtcttagtttcatatccttttgttttttcttgtttatactaaatttcattccctatgattccattacttagtctattaccggatgctgcattaccgggccccagcctactacctgcacggctatattcaagttggtatctacctcgggttccggatccggacctgggcccgggtctggcgttacgggaatattgtcgaaactttcgccgtcaaaataaatacggagacggtaaacgtagttgcgacggatgaaattatgatcatagccgttctgcaagccacccgcattgatcaccgccgtgaagattttcgtatggtcttgataactggaattcccctgcaaggtagcttttacggcgatcatcgtgtgatcgtcgcttttcatattttccattacataatgaacgaatggcgtattggatatcgaagcgccatcatttaccaacagatcctcgaacgaggtatcctccgaatttcgcacggcatcgggagcctctgtctctccccaatccgcctcactgaaatagtaagactttgtcttcatattgtagatacctaccgcatcgattcgcacctcacgtccagcgaacggcgttccggcaaaacgagtggatatattcaccaaatcaatacgtgcggctacacgggtcaaaaggatcgggtcggagatgccatccacattctgatcgccaagatccgtatatcctaaatagttatcttcctcagataaagcggattttgtaacgatcacttgactactcatcgttaggttcgtttgcgattgcgaggagaggtctaccaagcgagtctggaactcatcgtaggtagaaatggtagataataaatctctcggcacgttcgccaagacaatgatccgtgcccggacagccttcgttgtcggcacatcggctattatggcggaatgttccgccccggaaagagcctcccatttataaccgagcagttccgtgccggtctcattaaatactaccactgccaaattattgatataagcctcaccctccaactcattcacgtcattggggttataggctttcgtagccgtaccggacgccttgacagcgacggacagcttagcgccttctaaggaaagaaccggatcctcatctttagaacaactcacacaagcgagaatcgccaaaccggataaaaatatgttcgctaataatttcatgttcgtatcgtatttcttaattatatatgatgaggtaccctttaatgcatcggaatatcttcttccactactccccaaggacgaacggttgcccggacggataaggttccgccctcaccccattcaaggatcagatgggtattctctcctgcgctcgtataaataggatcaccattctcgtctaccttggccgagcctaacgagactccattggcgcttatcgacacagccatatcctgtcccggacaagcggtttgcatagtaggggttatccattcaaccccggactcgttccacgcaccttccggattataatatacgctatcgccaatctgcgtgccacggtaatcaaaaccacttaatgtattattcaagtagaagtcgcaatccacggaacttctcaaccccatcctgccgagttgctcttgcaaccctcgggtctcgatcgtgaccgtacccactttcggacgaatcacgatctcagtctccttcgctacgcctccggcttttgtcaacacttgttcgctaccataataaaggctatccggggtaaccgccaaaccatcttggcttttcaacatcactttcaagtcctctatggtctgggcctccgatacggattgcttttcacccaaggcattcacgttgccccatgccacgatacgtagactacgatcggcggtatagccatccaaaacgatctcattgcgggaacggataaagttcttatccaagctacgtttctccaagtaattcagattctcgtcgaatatatacagatcggtagattccatccatccgtattccgttatatcgtctcccttgatattctcgaccttcagtttgagcgtatagcactgatccaaatcctccttgatgcagctagtcgctatcataacgaacacagccacaaccaagagaagcaattcctttgtaaacagtatgtgtttcataatcctaattttttcttatcaattattttaccctatattgctttattctacttcctcatggatagtcttcacgttccatggctccactttcacggatgcgctcacattggtggagatcatcgggtcgtatgggatctcggaaccggggccgataatcgttaaagagatctcgtatttgtagttacgttggacgtaaaacttactccttttttccgtgccatcaatcgtcacttcttctccgacaggaatcgcataataacaattctctttcgtaatagattctttcgcaccttgcgggagataggtataatcaccttttacgatcaataaggtatggttggcataagcctcattgacgttagattcaccggacttcacctcaccctttgtattctcgtaaacataaaattcatgattcaaagcctcatcacttgttgtattttcttgaactaacatctcttttaacgcctgagcccctttcttgtaagaaccttcgtcaatattctctgaaaactctcgaccaaccatatattttaaatatccaagagccggacctgtaaaatcaattattttctctatcgctccccactcttctttagaagccacacttgaaacacctttagcgctagcgataaagacctcctttaaaaggaaggatacacttttataatttgcgttttccggattgcttgtctctactttttttaaagcgatcgaagcgacattacgaaccaaaggaacggggcctcccccacaaatttccttacctgaagtctcatttatcgttattatatcaccaatattcttagcataaccgatataattgatggtattggctattagcgttacggtaaacactttactactcatcgtcaagccttttgtcaaagtctcgtcagacagattgattgttgtttcaataaagtcagttatatccttagcctttgccaattcggtttggataacaggggcagcgttcgccacaaccactacatgagcttcacccgcatacacttcttgcggaccgacatcctttgtcccatcagagttaggagtagcatcttttgtatatatcacactccatccatcaactccaaacaccccaaccgttagcgtattcacgtccgcatccgttggagtagtttctccggccttcgtaaccgccccttcctcactcttgatagccaaagctagttgagctttctctaagacaggagcctttggaatttctatttcattatcatcggaacaagcggcaaatccgcatagcaccaacgataaaagaatgtatttcttgaatctcatagtataatattttttgttctcacattaatatgtgacaaaaatagaaaggatatatcgtggtgctgataggcagaactctctataataagagacaaatgtatcaatttcataaaagtgataggtttccctaccttttgcaactttcacctacaaaaacaggctcaatccgtgtattttatgctaccggggtggtactcggatcatcctagtaacaaatatacataatcacttaaattcagcaaaatcatggcaagaaaaaagaatgagatgaaagcgaaagagcccgtaaagctccggttcaagaaactgtcgaacgcgaacctgtccatatatctggacatctattacaaagggaagaggtattatgagttcctcaagctctacctcaccccggaacgtttccctgaagaccgtgataagaaccggatcactttgcgcttggccaatagtatcaaggcacaacggatcattgatcttcagaacgagatttacggtgtccgtatgataaacgggctcgggaaaaaaacacttttagaattcctctcggaattgtccaccgataaatctgcgcatggcgacaaagcctattccctacgattaagaagtctggccaatcatcttagagactatatgccgcaatgcctgcttaaggacatagataccggtttcgtgaaaggtttcatcgctcacttgcgtaaacaaccctacctcaaaagcgacttcacgattcacggttattaccggctcctgaatgtcacactcaataaggcggtcaaaaaaggactgatcctctcgaatccttgtagtttgctggatacagacgaaaaacctcacaaacctaccagcctgcgtacttatttgaccctagaggaactaaagaggttaatccggacagattgcgtatgcccagaggtaaaaaaggcttttctgttctgctgtttctgcggactccggatcagcgacttgaccgctcttagatgggaagatatgcaaaaagaaggaaatgataaattccgtttacagatcatacaaagaaagacgaaagaggctatttatctcccattgtccgaggaagcgataaaataccttcccgcaagggagaatgagaatgacaggctcggcttgatattccatctacctagcctcacgattatatgtcaggtattaaaaggctggactttagccgccggcatcaagaacaagaaagtgacctttcacgtaagccgccatactttcgccactctttcactagctcttggcattgacttgtatacagtatgtaaattactaggacacaagaacatcatctccacacaagtatacgcgaaaatcatcgatgctagtaaaagacaggcaatagaccggtttaatggcgtattagacgcatgagacggatattacttcagattcgtatggcacggatcaagaaagatacttctccccaagatccgtgtcatccgctatagtttcagtccgcaactggcttatcagatcagagactttgtattatttccaacgaaagccccgtgcattcggcgattaatgaaagatcgacaccggctttcttcatgttacgagcgttgcgtagggtagccaaacgctcaccttctgctttaccttttgtttccgcctcctccacggcgtactccatcgtggccttccagtcacggtagatcttcagattctcatcgtacgtcgcacgctccttgggggacaaggcattcacattcgctacgtcgagcaagcgtcggaagtatgcctctttttctttaaatggggacatatcaaatagatttcatattcttcaatacataaattgttttttccagcggagtctcgccctgacgggagatcatacggcaaatgtaataaaaacctcgattaaagaagtaacgttgagggtaattaatactactgagttgttacttcccttcacacaacaaaagcctaatcaactaaagaacaaccccctataaccattccccaatagaacttagaaatttattattcgggacaatgatcgcttgcgtgttcgcggcgtgttcaaacgaggatgatcctatccctagcgtggatccgacacctacaccggaagcaggcaccgctgatcttacgattgtggtgaaaaacttaacaaagagcacacagacaaaagccggcgaggatgagaacgccaaggaaggcgaagctaagatttacaatttatttgtagccctttataatgaagacggaacattcttacaagttagtgatcttacagctaatgaggatgaagaggttactgattcaaacaatgagattcagtttaagggattaaaggctggtgcttcttatcgtgctttggctttcgcgaatgttccaaaggatgctcttaccgcaaccgctaactcttttgagttgacatctgcttactatgtcttttccggagaaggagcgaatgggttacctatgagtagtggtattagccctaaattcactcttgccgaaggtgaaaattattatggttactcaaacactacaggaggacacagtattgaatctggaaaacctttaggattaattagaaatgtggctcgtgtggaattgaatgcccttgatttggatatgactaaagtcaaggttgatggtagtcaaaaatacaaatcaggaacgattaagtttgtgcctaaggatgtttttgtattacatggtcgtacaaaagctaaggtggcagaccaaagccaaagtaatacagagtggttcaatctgccagataaggtttggggtaatattgccactacttatgaaactgctgatggagatgattattattccgggactaactctagtaactcattcggccgttttgctggaactgtcgatgctgctaattatataaaggcattgagtacagcagaaacaacatatactcagaattgggatggtactgctattaccggaagtaaagcaattactcttgctaattctttatatttttatgtgttgcctaatgatcagacaaaagcggccagagaacaagaagatccggaagaagaaggccaggctttcgtcttggataaaacaactttggcatccgaattggtaatcagtggtgaagtttatataaaagctataatgaacgataacacatcttggacattcggcgaagagagtactcctgtattgcgctattggccgataaagattggtatcgatggattagatagtgaagacacatattatggtcaggtacatagaaacgtggtttataacatttctgctactatcgcaggtaatggttatgcagatcctactcttcctaagggggatcctacagctgacttgtttgtaaagacaatggttatgaactggggtacagccactcaagctcctgttatcgaataatacttattctttgaataataatcaaaaggcattctctatcaacagggaatgccttttgttataatatatatcaatgtccgttggctgaattagaaagttaaaagatttatgtttaagaagttgttctccccggacacgcaccagacatcgttctatgtgtagagaatctaaatcatctaccatatctaccattatttatgtaattttttgattgtaaataatttatcttgtggtggtagatagtgaacatctaccactacaaacttcgatctaccatcattaggttaccagaaagattagcacaaacaattaccactaacgataaataatgtataacattctgtatttcaataaataatagtttttttgcatagaaaaacaaaaattttgctatagagaaacttttgtttctttagtatgaaataaaagtttcttcagtatgaaaccactaacttcacctattgaaactcttattggctttaatccctttgtctgtctcttataaaatcgtataatactaaatatacgagtccgcaagcttgggaagtgatttttttgcgtttcccattaaaacatggtagatgcagaatgaaaattgtagatgttattccatctgcaaccactatataacatatttatttacaataagtatgaggttgaattgtagatattgtagatattctcatgaaataatattccggctcttaggttcaagacatatgggatcgccatcataaggaaaagatagtaaattttgtagtctccggatcaatttataaccagaattatacatgcaaaaaaggcactcccgataaaaggaatgccttttggacgttattcaaagaatagatattattcgacaactgaagattgatttgcgctaccccaatcaagaacctttgtcttaacaaacaattcaacaaagtctgttggaggaacagtaggatcatcatatcctctaccggctaaagttgcgtcaatactgtaaattatattacgatggatctttccatcctttaaatactcagccgtagctgctgccatttcattcgtcgcagcaattttaataggccaatatgctgttttctccgcatagttgtatactgcatcacttccgctctttttagcattttcaagcttataagtacctttaactacaatttcagttgcaagatcctctggtttgaaattttcagcaccattcatttcacgagcagccttaacttggggattttcgaacacatagaatttaggggcgattgtgatagtcgcagacacaccatcttcagttgcgatattctgtaccaatgcggtggctggtaaactggccttgtatccttcaataatagaacctctcatattcgtaaacatagcgtcatcattcacgaaatctcctctataacctgaagcataatctgtagcattagcagcataagttgcggacacattaccccatacggtattgctaacgacattccaccagctattgccattacccatatctgctgcattggacttcgtccgcccatgcatgatgaatacacattctggtacaatcgtcgcaattccttcaacgtatacatcttttgcagctctagtcatgtctaagctaagtcccgtaaaatcaatgcgcgctacatttcttatcaagtacaagggatctgctacaagaatatgttcaccttctcccgctgttttagtatatccataatagtttttacctgcttgtaaagtgaatggatcagacaaaccactactcattggtaaataattttctgcgaatccggcagctggcatcgtatatacaggagatacaaagttgtcaattgttgtaccagccagtgagatttcaggcatattagcaaatgcgatagcacgtaattgcgcaccttctgtcagtccggcaaattgaacctcatcattatccgcagcagcatcctcattggcaatatcagaggttgaagcgacaagcgctccagtttcagcatcataaagagcaactgttaagtttgtaattttagcttcattttcagtctgtgtcccctccgctgcagctttagtcaaacttctagccacatttttcacagaaatagtcagtgttgcgttattttcccctgtttgcggttgatccggtcctacgataggatcatcctcgtttgaacacgccgcgaacacgcaagcgatcattgtcccgaataataaatttctaagtttcatatacatataattttatgagttaataaatcttttatataaacctttctttctcaatcactttttacattttcagtcacataacaagaactctttgttcaaatcttccccatgaccaatctgttgttcgttaatgacattgcaaaggtatttggacgataaaaaaaagtaaataggtgttactttcataaataagaggtaaaactataaattttcattcgggatattttcgggctgattagcaccgttgtaaggctatcaaaaagaggttgaaaaatatcgtttcaaaaaacaaataaaaaattttgccattccccgacgattattcgggaaatggcaaaacgattaattcttacccggcagatactgtgaaggagtgacgccgtattgttccgtaaaacgcttacggaaagtggcggtatcgttgaagccgaccatttccgaaacctcttggatagagtatcgctgcatactgatcagctcggcggctttcttcaaacgtaccatacgggtaagctccaatatactactatccgagtagagttttatctttctatataatgtagggagactcatgtttaaagaatccgccaaaatcttcgcctcaaaactagggtcatccaaatgtttctcgatcgttgagataaccgcatccataaaaagattggaaggggaatcatctttctttaccgttttctctccctcgggatgcgcacctacagaattcgacgtatagaaacgtctcatctcatccctacgtttcaataaactgtttaccttacttcgtaacacctctacatcgaatggcttggttatataatcatcggcgccacattcaatgccggctataacatcctcactctctacctttgcggttagcaagacaaccggcacttgcgctaattctgggatgcctttgatttcacgacaggtagcaagcccatctttaacgggcatcatcacgtcacataaaataaaatccggccgttcaactcgcgcgatctctacaccctcctggccattatgagcttccgaaacatgatactcactggcaaaaacatgacgcaggaaccaacggatctgatcactgtcatcaatcaccaacattttcttcccggtctctttctttttcggaacaacttggatcaactcggcgatctcctccttctgcatctcattcagctttaccagatcaccatctggctcgatgaattccacggcacgttccatataatggcttctccccaatggaatcaatatcgtatattgggttcccgtctcgtcctccgatgaaattccttcgaaaatagcgccggaggattctgtcatatccacgatctgtttcaaacccaaacgggtactttcgctttctcctaacccatcatcttggatagagaaagaacaataagccttaccattcgagcgcaccacggaaatattgatcgagatctttccaaagcggtaggtattttttaacgcattagataaaagtacacgcaaggcaaactccatcttccgacgatctatccagacccaaagaacagaggtttgggtattaatatgaaattccacattattcatggctatccagtccacgaataaatcacaaatctgctttgttatactgatcatgtcataacgagctatccgaagatggtttgccacgtcatctccatgacgggtatttcgcaattgctcgataaggtcttgaagagccaaagtattacggtaagcagacaataattgagtcgcttcactagagtcaatatcatttttacgttgcaacaactcactcaacgaaccaagcacaagcgatagtggagtacgcatttcatgaatcgtttcaacaaaaaacgaattatggagcttttccatttcctcaaggcgctttttcaaatcctcccgttctacctcattatccctattccaattatcagtctcacggattttattgaccaacatttgttggatctcccgattttttacgcttaacgcatcgacagaccgaagaagctcatcgtttctcgccataagctcaccacctttggcaatattctctttcttcaacctatacatataataactcaaaaaagctattacacatatggacactatcagtaaaatgataaaaggtagaattccttgagagccctccattgtatcattgttcgcagcaatataatgagcttcaacgaacaagccccaaaatgccatcataaatttcgctttaaaaccttttgatctcatatcattgattattaagatgttatttatataaaacgccagtaaaaaacgttcgtttaaatcttgcgtttttatcttcaacttttttgcagccttacaaaggtcaaaaattttatttaaatttcagttattcagttggataaaaataataaaaaaataacatgattatcaatgagacttcataatttatgcacatgaaaacgcaagatttaaacgaacgttttttactgtcgttttaatagacgttaacaacaactgcattcctatcacacaacagaggcaaggctatcaataaggaccagcgatgatatatttaccactcaaattgacaggaataaacccattaacattatttaatcatcatccgaaacatgcatcaacagaggaatatagaggtataatgatagttttacccacttttttgataaaaatacccatcacaaaagatacaacctatgatttttatacatacatttgcgatgtagtgataaggaaagaccgttgaggggcggtcaaaaaaaccaagtcacttagattaagggtaaagcatataaaaagtagggtcatgaaaaggggtaattttttcgcaaattgcgtatttgcggtttctgttattttaacagttttgtcattctccgcttgcacggatgattcaaatgacgtagtagcaacaacaagtgaggttattgaacaagccgaagtaccattctccgtggtattaaaagcaatgaattcagatggtaacgacattacgaccaagggagaggtgaatggagctacattatttgtcttcgatcaaaacaacgatttcttcgagcagattaatgtaaacaaatctacaattttatctcgccgggctatagacattaactgtccgaacagtaatgacataaccgtgatcgcatggagtggaatcaattctggaaacgaagagatttcaaacatgagcaaagccaatattatatccgatttgcaagtcagcctaaaagagaataacggcatagctaatattccgagcgatttgttctatggacaagttacgcttcataagaactcttcaacaaaatccaccgtatcaaacgaattacaaatcattcgcaaaacttcaattttccagctttcaacaaaaggactgatcaagtatctagggagtaatgccggaaattttgaatatcgaattaaaaatacaaaaagctcattggactacaatggcaacccaacaggagaagaggttgaattcgctttccccgcttcttttgacgaaaaaggtaatttgacaacagaaacccaagccatttttccggctcaaaatataacggtagagctttacaaggacggcaatcttattttttctagcgaaaaagacaaaaatggagaattattcgctgcaacccccggaaaacgcaccgagatcactttcaagtactccggagaagtttcggctaatattacaattgctgactgggcaaccgttatccaacatataacaatgaattaagataccctcaatttttatatgctttggcgcacgtcacgagattagagaatttcgggcgtgcgctgtttttctctcaaaaaccgcattctccgtgataggaatacccatgatattgacacgaacaccgtcttaactttatttaaatactaacgaaaacccgcttcatcacaaggttcactccacctgttgatagttttacacactaagctgatataaataccgatcaaataaagatacaacctatgaatattatgaatatattcgcaacagacattagggtaagcatataaaaatcacagcagggtcactacataaacaagggtaactagatttaaattttatatgctaaacgcacgcttcagatgatttccgaggcgtgcgttatctatatgatagaaatacattctcctattgagacaaataccatcactcaaaacatttagacatacatatctttgtatttataaatcaagcaaagcaatttgcgaaattttaccctatgaccctgcttacatatataattacccttaaattatgatgtaggcaaacctaattaacataaccgcgaggttacataattattttgcctgaacaatcaagatcgtttacgagaaagattgttcaggtttttttatcctcccaaaagaccatctgatagcaaaagaaaaaaggacataaaaaaggagatcgaaaaatcgacctccttttctaggtagcgagacccgggattgaaccggggacctcatgattatgaatcatgcgctctaaccagctgagctatctcgccatcattttattgtcactgtttctcttattgacggtgcaaaagtaggggttatttttgaattacacaacattttcaataaaaaaattcgcttaatttttaaggtctccacctaaacagttagttattagatacttttttcatcattaaaattagtcgttttcaaatcttttacgtatcttgcggcaaatataaggataagaacaatgaagaaagagaagtttcatatcgaatacattttcgataaagtttcacgacgaagcctgtggaatcacctaaccaccgctttgggactttccgcttggttcgccgacgaggtcattataaatgataatctctatacctttaaatggagtaaagaggcccaagaggcaacagtgatcgactccaagccggagaactttatccgttaccgctgggtagacgaggaagatgagaacgcttatttcgaatttataatccatacaatcgaattaacaggttctacggcacttgagattacggatttctccgaacccggggagaaaaaagattccattaatttatgggactcgcaagtggaagatttgaagcgaacgcttggtatttagagtagttttacagaaatctgtggggtgttatcgttttttacactacttttgccacttcaaccagattaggcaatgttgagaataaaacgattatatacatttatgctgcagacattcctgccgttgtttcttatgacattcggtatttgtctgtttattgtgttgatgcaatttctttggcgatacatcgacgatatggtgggaaaaggccttggcatccctgtattagcggagatgtttatgtatgcggctttgttccttgtcccaatggcacttcccttggctattctattagcctcattaatgacttttggaaatttaggggaacgtctggaattactggccatgaagtctgccggggtatcattgatacatatcatgcgtcctttgatcgtaacgctcctattcgtgagcgtgggagcctttttcttccaaaacaacgtaatgcccgttgtccaagtcaagctatatacattattatattccatgcgccagaaatcaccggaattggatattccggaaggttcattctacaaagatattcccggattcaatgtatatgtgaagaaaaaggacccgaaggacggtttattaaaagacgtgatgatctatgattattcggaaggattcaataacgcccgtgtaatcgtagcggactccggacggctaaagacatccgccgataaattattccttgtcctatctttattcaacggagaatctttcgagaacgtaggtaaaagccaagccaacacgacgcaagcgagaaccgccgtcccctatcgacgagaatcattcagcagcaaggatatcttgattgaattcgacgcgaatttcaaccgtaccgacgaatctttcatgcagaaccaatatatgggaaaaaacttgaaggatttacaaacctctatcgattcgatgggcatacgcttggatagcatcaaggacgtgaacgcaaaaagcatttacgatgcctcatacgtaaaaacactaaagtccttacgggctaaaaaagagagtgaagccgaggggcaaccagacgagcagcaggaaaaattgccggtaatcactcctaccatccagttggatttcgacagtctttacctagcgcaagcagcgagtagccaagccgccttattaggtcgggccaaatcctcgatcgagaatatcaagaccgactattatttccgcgcggccacggttggcgacgaggcctataaggtacgccgccacttgacggaatggcataagaaattcacggtatcgttcgcttgcatcatgttcttctttatcggagcgcccttaggagccatcatccgtaaaggagggttgggcgtgccggtcgttatctcggtaatcttgtttatcttctattatattatagataatatgggcttcaagatggcacgcgacggcgtttgggacgcatgggaaggtatgtggcttagctccgtggtcctaacacctatgggtatattcctaacctataaagcggtaaaagattctgttatcttgaatgccgacacttacgtgaatgccttgaagaacttaataggtaagcgtgaagggcgaaaagtggaacggaaagaggtgatcatatacacccccgattatgaggccaccctcccccaactggagaaattggtggaagaaagtacgacttatctgacaaaccataaacgttggatcaattatctgacattttggaaacaaggaggaaaagataacacagcggaactgttagctcaagacacggaaaatatcgtggaggaattaagtaattccgaccagaatttgctcttgaataaattgatggactacccggtcatcggaggttacaataataagctaagcaagcatataaacgggaaacttgctttggctatcggtattttcttcccactgggattgccgatctacctattggctacgtaccaacgtaaattgctacggcatgatatcgttatggtacaaaagaccagtaaggagctgatcaatatgatatattcattacatttgctaaaaaaataactcggatataaataatcaataaatatgagcgagattcaattaaacaccatcgaagaagctatcgaggatttccgtgaaggaaagttcttaatcgttgtagacgacgaggaccgggagaatgaaggagactttatcatcgcggccgagaaagtaaccccggaaaaaatcaacttcatgttgaaaaacggacgaggtgtattatgcgccccgatcacggaagaacgttgccaagagttggagctggatatgcaagttgccaataacacctctttactaggtactcctttcacgataacagtagataaattaggagggaaatgtacgaccggcgtttccatgtacgaccgtgcggaaacgatcttggcgctggctgatccaaagaccaagccatccgatctgggacgtcccggacatatcaatccgctccgtgcccgctctcgtggcgtacttcgccgtgcgggtcatacagaggctgccgtggatttggcccggttagccggtttatatcccgccggagccttgatcgagatcatcaacgaggatggaaccatggcacgtctgccgcaattaattgaggtagccaagaaattcgatatcaagattatttgcatcaaggacctgatcgcttatcgcctccggaccgaatcgatcgtagagaacggcgtagaggtagatctccctaccgagtacggacatttccgtctcattcctttccgccagaaaagcaatggattagagcatatagctttgataaagggtaaattcgaaaaagacgagcctatcttagtacgcgtgcactcatcttgcgctacaggtgatatcttcggttccatgcgttgcgagtgcggagagcaactgcacgaggctatgcgccgcatcgaccaagaaggcaaaggggttatcgtttacctgaaccaagaaggacgaggcatcggattgatggagaagatgaaagcatacaagctccaagaggatggtttggatacggtggacgcgaacttgcatttaggccatcaagcggatgagcgagattatggtgtcggagcacagatcttacgtcatatcggcgtaacgaaaatgcgcctgatgagcaataatccggtaaaacgcgtaggtctggaagcatacggacttgaggtagtagagaacgttcctatcgaggtgaaaccaaatccatacaacgaattctacatgaaaacgaagaaagaacgtatggggcatgtgctgcataacattaaatagttatcagaacgttgcaagaattccgattattgattacttttgtcgcataataataaaacaacctatacaaaaagcaatgtcatgacacaagtctcagatcgtttagcgagtttatcgccttcagcaacattggcgatgtcacaaaagagcggtgagttgaaagctcaaggtatcgatgttatcaacttaagtgtgggagaacccgatttcaatactcccgacttcattaaagaagccgcgaagaaggcgattgacgataatttctcacgttattctcccgtagcgggttatccggcattacgtaatgctatcgttgccaaattgaagaacgagaatggactggaatatacagcaggccagatctcttgtgcaaacggtgccaaacaatccgtttgtaacacggtcatggtattggtaaatccgggggacgaggttatcatccctgcccctttctgggtaagctatccggagatggtgaagttagcggaaggaactcccgttatcgttccggctggtatcgagcaagatttcaagatcactccagctcagctggaagccgctattacacctaagactaaagcgttaatcctttgctctccctccaacccgacgggttctgtttacagcgccgaggaattggcaggtttagcggaagtattgaaaaaacatccggatatcatcgttatagcggatgagatctacgaacatattaactatattggtaaacacaacagcatcgcttctatcgaaggaatgaaagaccgtacggttatcgtaaacggcgtttccaaagcgtatgcgatgactggctggcgtatcggtttcatcgccggaccggaatggatcgtgaaagcggttaataaattacaaggacaatatacctctggcccttgctccgtatctcaaaaagcggcggaagcggcttatacaggctcacaagaacccgttgaggaaatgcgtaaggccttcgaacgccgccgtgacttaatcgttaatttagcgaaagaagttccgggcttcgaggtgaataaaccggaaggcgccttctacttattcccaaaatgtagttattattacggcaagacagatggaacccgtgtaatcaacaacgctgatgacttagctatgtatctcttagaagtagcgcacgtagcttgcgtaggtggtacctctttcggggcacccgagtgtatccgcatgagttacgctaccagcgatgagaatatcgcagaggcgatcaaacgtattaaggatgcgttggccgcattgaaataagaaaaaattaaacagatatacttacttggcaaagtaagatatactgcattggacaagtaagtatatcttctatgggcaagtaagctatacttcataaaaaaggcgatacattgggttgtatcgcctttttctttatatcaaatatgttaccgcaattactcagcacgcaaagtgaaacgtttgaacgccaagatttgtaactcaggatcgatctccttcattgtctctcttacagtcttcttgccatccataatgtcttcttggttcaacaagcaaacctctttcaagaacttgcccagacgacccttagcgatattctcgatcatctgttgaggcaagttagcagccttctcagcagaaacagtagcgatgatttctttagccttagctacatcctctgccgtaatccagcccttatccatgttactttccatgtgagcctcgctgtctacatgtgaaggattgataccagccttcttcaatgcagcctctacagccttctgtacctgctcagccttcgtcttctcgatagcaacctggatctctttctcttttacagactcaggaacaccagcctcatcgatagcgatcgggttcatagcggcgatctgcataacaatattgtgagcggcttcctcagactccttgttgaaagcggcgatcgtacaaagttggttcttacccatatggttgtatacagtagtgtaagcaccttcaactacgcagtagccatccaactccattttctcgccagtgataccactacgatccgtaacagcttcttggatagtacccttgcccataggcaaagctttcacctcgtccaaagtacggcatttgttagccacggcagcgtccaagatagcttgagtcaaagccacgaagtcctcattcttagccacgaagtccgtttcgcacttcaaagcgatgatagcggcgaactcgccatccttcttagccaacacacaaccctcggcagcctcacgatcagaacgtttagcggcgatagcctgtccttttttacggataatttccattgctttctcgatgtcaccgtcagactctgtcaaagccttcttacagtccatcataccagctccactcattttgcgcagcttggtaatatcagccattgttacagccataatcttatttcctttatctttaaaatgtttatactttcaaaaattgacaatggacagttgccaattgacaaatcctgtcaaaagccaactgcccattgtatttgtattctaattgtcaattgtcaacgtcaattgtcaatcgaattattcttcgtctttcgcgaacttaccggcaacgttagcgttcaacgcatcgtcgtcttctttcttcgtacgttctttcttaacagcagcttttgccttacgctctcttttcggagcttcctcagcagcctctgcgtcaattttctcagccttacgctcttgcaagccttcgttcatagcctcgcagatagcgcccaagataacctctacagactttgtagcgtcatcgttagccgggataacgtagtcgatattgttcggattagagttcgtatcaaccataccgaatacagggatacccaaacggttagcctcgcgaacagcgatatgctctttcatcacgtctacaacgaacaacgctgacggaagacgagtaaggtctacgatagaacctaaagtcttctccaacttagcgcgttggcgagtgatttgaagtttttctctcttagaaagattatcaaatgtaccatcttttgtcatcttatcgatagtagccatcttcttgatagctttacggatcgtcgggaagttggtcaacataccacccggccagcgctcgataacgtaaggcatacctacggaagcagccttatcagcgacaacttgtttagcttgttttttggtagccacgaaaagaactttcttgccttgtttagccaagttcttcataacttcagcggcttcgtctactttagcaactgttttataaaggtcaatgatatgaataccattgcgctccatgaagatataaggagccatagcgggattccactttctttttaagtgtccgaagtgtacaccagcctctaataattgatcaaaatttactcttgacattgtttttttcttaaatcgtttactttctttgtttaatttcaaccatcaggtagtctttccgcatgtccacatgtaaaaagaatcccgataatttagatactaaacgcttcgctttacttgtaagggactcacaaataacattaacgtttactgaactggaatctcttacgagctttcggacgacccggtttcttacgctcaacagcacgaggatcgcgagttacgaatccttccgctctcaagacagccttatcttccggattaatctttatcaacgcacgagagatagccaaacgggcagcctcagactgacctttgaaaccaccaccgtcaaggttgatcttaatatcatattgctctgcgacgttcaactttgctaacggctgctttacgataaactgaaggattgaagaaggaaagtatttttccagctcacgtttgttgatcgtgatctttcccgtaccttcgctaacgaatacgcgagcgactgccgctttacgtcttcctattgcatttactacttccatcgtgattatttatatgagtttatatcgattaacttaggttgttgagcctcgtgcttgtgctcagttccctcataaacgtacatgttgttcaacaactttgcacccagacggttcttaggcaacataccttttactactttacggaacagacggtcgccacctttcttcaaaagatcagccggagtatactcgatctgtccaccgggatatccggtatatctcaaataaatacgatcgttccacttgttaccagtcagaacgactttgtctgcattgatgatgattacgttatcaccacagtcaacgtgcggagtgaaattgggtttgtacttaccgcgcaaaagcttcgctactttagcgcaaaggcgacctaacgtctggccttcagcatcaacaatgacccactctttgtttacagttgccttgtttgcagaaatggtcttaaaacttaaagtatccactgcttaaaaattaaattaattaataactcaaaaaactagccttaccaacattgtcacaacggacacatgatgcaacaacgtgctaagaactaaactcttagtacaatttgataataatcggcttgcaaaggtacgggttttatccgaaataccaaacaaatctaattatttttcaagttattatgaagatactcatcacttacggaagtaataccccaaagagaatgtcacgttattttgataaacggaagtctcgccgtcacgcttcaaggcacggcggtctatcatgccgcatagggaacttacggaaaagaaaaagttactatattctaccgataggccgacgttcatgccaaaatcgcaaggtttcaaatccttctcctcggatacgccgaaatggagatccggattggtctctcggctcttcatcttgccaaacaaggaccaatcaaaggtaggaccggcgaatacggacagatgaacgtccgtgaaggtaaacgtataagccacattcacgggaatctgcaaagagtaataccaacatttattatgaagcgccatcccatgtatatcctgattcgaataataagcgccaccttggtttacgaacgccacctcaggacgaagcgaccattttttattcttactcaaaggaatatccgccaaacccgctatgctgaaaccgaagcgggctcccgcctcatacgtatcctccactttctggatcaacgaagaataagcgcctccggcacgtacgccgaaagaaacctgagccatcgccggtaaaatcatcatcacggcaatcaacaacaatccgatctttctcataaacttcctcatttgcttttccttctaatagcaagcaaagatatacatttttcaataacatctacatttatcctactgaaacatacaggaaagctacataaaaagaacaactcatgaaagggccgctcaaaagttagccccgatcgcagaaacgaccgaggctatttttttcccaccttccctcctcacggaggcaacggtggatgaactttaatttattactttagtattaatattaatccattcccgcctattcgccctcacggggtacttgaatcactacaactcccgcaggaatgattttcgatttatgttatttatcgtcattattcttatttaacgactgccttaacagcttcctcgccttctacagacaccacaacgatacctgccggagcagcgatcgtagcgttatcggaagtaagaaccgtgttagcgatagacttgccaagaacgttcgttacagaaaccatcttgccagccgcaccttggatctcgatcgtaccgttgcctgcgataaccttgatgccttcggcagcatcagcgatagactcattggaagtaggatcaccagcagcgatagtgaaacgcatagcgtttttcttgttaccgctccaagacaatttatcgttgacaccatataaataagaacccttatcagctacagaacggatacgataagcgttctcgtcgtcctcacactggatgatctgaaccttgaagttgtccaagcctcctaatacaccctcatcatcagcctctttagccacggcaaccttgttacctttaacgatcgtagtcaaagtatccttactttcccaaagagtggccggcttgaagacagccttcgtgtcatcctcgttccattgatactttctgtcgtatgtaccgtctgccacatagtagtttacagagtctttcggattgaataagaacagtctgttaccatcctcaaccgtacctttgttagagatatagaaagaaggaactaccgcatccttatctgttacctgtaagtagaaagaatattgattctcgtttacaacgataccatcacgatcctcgttcatggagatatagttgttcatctcgcttatcagggaaatatgtccttcctcagcgggatagctgatttccggagcctcaacaatcaagtaagtattcaataaccaatcttgttgaccactcggagttgtagcgataggccatgcataaacagaagacggagtagtatatcgacattcgtcgatagaagccttataagtagcgtctactacagacgtcgtattcgcatttaaaatagaagcgatatttgagcttgtgcttgtcaccttaatcaaataaacagaaccatcagcagcttgcttaatcacaaaacgtgtagtgttattttcgtcaactaattcctcttgggcagacacgttagaacttcctgccgggaagtattcctcggtttcaatgccatcattgatatactgcaatcgataaacataggcataagccttatcacctctagcttgtacagtcacacgtccatccttgttataaacaaagctacgctcgatgatcgtacgtttgttatcctctttcaccaattgccattgagcggcgccagatacctcatttgcgaacttatcattcttattcaatatatactctgaagttgcaaaaggcaaattattttcggtagctgccacataccacttattagaagtctcgttgttatcacgagcaaaagccatcgtcaccaaagtctcattgtccacgttcaagaaaccagcgtatggatcaacttctgccggagtcaattccacgattagctgttgcatatcagcatcatcgccctctgcctcacgatatgtgttctcatttacgtagatagcggtaactgttttgttatctgtagccaattcgtaaacattctcgcctaaatcagttttcgggaacaagctagcttggaaatactcgccggtctcacggttcgtgaatgtcactttatatgtatcgtctacactggaaatagcccattgataagccggagtttccaattgagaaagaaccttagctttcgcaacaaattggaacgaacctctcttaacagcattcgtcaaatactttccatatacgctcttgatgtctttcttatcgacacccttaccatctaagacacggattgtataagcagaaaccttcgcctctgtattcaacaactcaataccgctcttcatcccggcagcaccttgcttgaatataaagtagttaattgggttattgctagcatccgtcaaagtagaagtagtggccaaatagtagttgtcattgtgcttcaagatatgcaacttcaccttggcatctgcttgatccgctttgctcgcttgtttgcggtaacggaatcgatccacgttcaactcatacggatagccctcggaataactcttctgtacacggaagttagcgttgtttatggagatctcatcgccagcggctttccagttggaagaagttccttgatacaaattcaactcgctgatctttttctctaccaacatgaatccatcaccagacgcacgtcccgcatttgtaccttccactgtttcggttgagcttaaaaccaagacagttgcgtccatccaagctttataaccgctagaaacagcattaactccgctacaatcatccttatcaggtgcattctctgtaaagaagtacataccagcgggaatcttcaaatcagccgtacttcctgaataggaaggataagaagtagcgtccactctcaagtcagaaggcacataacgggcaacgattcttttctcattgaatagattaccattaggctcgctagtctgatcggagtccaatctttttgagacgaaagagaaacctgccgtgttatacaaatcattcaactcatcagctcccacagcccctaattcctctgattctaccgcatagaaagataaatcaaaagacgaagccgtagttgaaattaaagagccaccagcactccattttaactggaatacatcactcttattcccgttataagcgaatagagccttctcgcttgcagtatatttacctgttgttccgatttgagtagctccaaatgcaaaaacatctttaatcacatttccagaagccgcactattcaattctacggcctctgaaccagcagtcgtgttgacacgtagagtcttacctgtggctacattctcaaatttgtacgaataagcgcccaaattctctgttacggtaactttccagatatactgctttacatcatctttcttgtcatccgcaatagaagtagctttataatcaagaataccttcttgtaatacaccatcctcgcttacagaagtaaaaccatacgctaaaccgttggcatccgtcatcacataagctccggatttcagttccgtaacagcactacccaagcccaataatctttgaatagagttttgagcgaaggcactaccgcacagcgaccctgccacgagcagacccgccgttaacaatgtagaaatctttctgttcataatttagaatttaatattaataatagtgttaattaagcacttagctattttctgatagcagactaccgttagaaaacgactagtctaaaccatcgtttagatcttgcgtttttcgagagatacaaaggggagtttgtggaaggaagagcttgtttcgtaaaggatagcctatcctattgataagaaagcgaataaggcatgaaaaaaataacacagaagggttgcaagtgtcaaagaaatgcgtacctttgcaaatgactaattaaaacgatcgtttaaatcaatcatttttctcttctattatttaatgtacatgcgtacattagtaaatacaccatcgaataatcaacaaaagtaagatcaccttttgcgatagatcggaatattagtttcccttgttctagcaaaaatgacactttgtaaacagaactccctgagattcgctttttccaagcataagtacagtataaaacggcttttcacacagaaaaacgccattcataactatcttccatccgctagttcgagcacctcacgaaaacctcctgtcacgatatacggcttatatcaagcaaaatatcaatacaacatctgtttatataacatatagattctatagaatcacacatattataacctcattatatccttcagaaaacacgtacgtctttttccaaaaacatgtacgtgtttccgaaaaaagacgtacgtgtttttttaaaagcaaaacaacctctctcgtactaaaaaatatttcctacctttatgcactcatttcaatatgcaccagactatacattaatatatatggaaccgtttattcatttacacgtacatacccagtattccttgctggacggacaggcatccatcgacgcattgatcgacaaagcgtacaaagacggaatgcgtgcgatcgccgtaacagaccatggcgttatgttcggtatcaaggagtttttcaataaggttagcaaaaagaacagtaaacctctcgggatcatcaaggactccgagaaagaactaaaaccgctgctggccaaggatgcgccaaccgatgaggaacaacaaaggataacggaactacaaaaacaaatcgccgaagcgaaagcttccatcttcaagccgatcatcgggtgcgaatgttattgcgctcgcaacggaaggcatagcaagctggcctcgcaagacgaccgtagcggctggcacttgatcgttctggccaaaaataagaacggatacaagaacctgatcaagatggtatccctctcatggacggaaggattctacggacgtccgcgtattgacaaagagttgttggagaaatatcatgaggatctgatcatctgctccgcctgtttaggaggagagatcccacagcatatcatgcacggacgaatcgataaggctgaggagtctatcaaatggttcaaaaacttattcggagaagactattaccttgagatgcaacggcacgagacacacgaccctaacgctgattgcacgattttcccgcatcaacaagaggtgaacaaggtgctgatcgagcttgcgcacaaatataatatcaagctaatcgccaccaacgacgtccatttcgtcaatgccgacgacgctgaggcccacgaccgcctgatctgtcttagcaccggcaaagacttggacgaccccaagcgtatgcgctactccaagcaagaatggatgaagacaaccgccgagatgaacaccatcttcgccgatatccccgaagctttgagtaataccctcgagatagccgacaaaatagaattctactccatcgacagcggtcctatcatgccgactttcgccattcccgaggagttcggtaccgaggagtcctaccgtcagaaattgacagagcatgatttatttgaggaattcacccgagacgagaacggtaatgtcgtattaagcgaggaagaggcgcactccaaaatcaagaaattaggtggatacgacaaactataccgcatcaagctggaagccgactatttggcgaaattgacatacgacggagccaaggagctttacggagaccccttgaacgatgaagtaaaggagcgtctgaacttcgagttacatatcatgaagaccatgggtttccccggctacttcttgatcgtgcaagatttcatccgtgccgctcgtgaggaactcggtgtatccgtaggaccgggacgtggttcggccgccggatctgccgtagcttattgcttagggatcaccaagatcgacccgatcaaatatgacctcctgttcgagcgtttcttgaatccggaccgtatctccctccccgatatcgataccgacttcgatgatgatggccgtggcgaggtcttacgctgggtaacggagaaatacggtgccgagcgtgtggctcatatcattacttatggtacgatggctaccaagtccgctatcaaggatgtcgcccgggtacagaaattaccgttatccgaatcgaaccggttagccaaattggttccggataagatccctgacatgaagaagttcaaattgggcgacgccatcaagtatgtgccggaactaaaagaggcggctaacggaaatgatccgctggcacgggataccttgaaatatgcccagatgctggaaggcaacgtccgtaacacgggtgtacacgcctgcggtgtcattatcggacgttatgatatatcggatgtcgtacctgtcagtacggcgaaagacaaggataccggcgaggagatgctggttacccaatacgagggttccgtgatcgaggaaaccggattgatcaagatggacttcttgggcttgaagaccttgtccatcatcaaggaagcgatcgagaacgtgaaactgactaccggacatgatctggatatcgaccatatcagtctggaggaccccaagacttataaattgtattgcgacggaaagacaaccggtacattccagttcgagtccgccggtatgcaaaagtatttgaaggagttgcaaccttctaaattcgaggacttgatcgccatgaacgccctgtatcgcccgggcccaatggattacatcccttcttttatcgcccgtaaacagggtaaggaggagatcaagtacgatattcccgtcatggaacgctacctaaaagatacgtacggtattacggtctatcaggagcaggtcatgcttctatcccgtttgctcgctaacttcacgcgtggtgagagtgatgccttacgtaaggcgatgggtaagaagttgatcgagaagatgaaccacttgaagtctaagtttatggccggtggtcaagccaacggctataaagaggaaactttaaacaagatctggtccgactgggagaagttcgcctcatacgcattcaataagagtcacgctacttgttattcatgggtggcttatcagaccgcttacttgaaagcgaacttcccgtccgagtatatggccgccgtcttgagccgaagcttatccaatatcacggatatcacgaagttcatggatgaatgtaaagcgatgggtattcaagtattgggaccggacgtgaacgagtctatcttgaagttcagcgtagataagaacaagaacatccgcttcgggctaggcgccgtgaaaggcgtaggtgagtcagccgtacaaaatatcatagaggaacgcaagaagaacggcccgtacaagagtatcttcgatttcgtagaacgggtgaacttgaccgcttgcaataagaaaaacatagagtccatggctttggccggagcgttcgataacttcggtatccagcgtgagcagttcttcaccgacagtggaaaaggggaattgttcttggataccttggttcgctatggtaacaaataccagatggataagagcacggcagtcaactctttattcggtggagacgccttgatcgccatcgctaaaccggagatcccgcaatgcgagcgttggagcgatctcgaacgcctgaataaagagaaggagttggtcggtatttacctatccgcccacccgttggatgaataccgtatcatattaaagtatgtatgtaataccggcatggtagaacttaacgagcgggaaaccttacaaggccgggaagttttattaggtggtatcgtcaccggtttccgggaaggaatgaccaagaacggaaagccttacggtatcttgaagatcgaggatttcacgggtagtggcgagatcccgctttttggacaggattatatcgaatacagcaagtatggtaaaatagggatgtatctcttgatcaccgcccgtgtagagcctagccgctgggaccccaataaactggacttcaagattggtaccgtcaaccttttgcaagacgagaaagacaagctgatcgagaaaatcagtatcacggtcccgatccatgatttggacgagccgacaatcaatgagctttcggtattgatcaagaacaatccgggccatagcctgttatattttaaggttgtcgatggggaacataatatttccctaaatctcttctcccaaaatatccgcttaaacgtgacccgtgagctggtagactttttacaggagaacgagaatatcgattttaaaattaatggttaaagttgtacgacgctgaaagaatttgtacttttggcgtcataacaatcattagattataattcataattaaataatacgtaattcaaaatggcactacaaattacagacgctaatttcgaggagttggttaactccggaaagcccatggttcttgacttttgggcagagtggtgtggcccttgccgcatggtatctcctatcattgatgagttggcaaccgaatacgaaggtcgtgtgacgatcggtaaaatgaacgttgacgagaatgacgatgtagtcggacgattcggtatccgcaacatccctaccgttcttttcttcaaagacggtaagatggttgataaagtagtaggcgctacggctaaggataagttcgtagaaaagatcgaggcaatactttaataattgagaattgagaattgaaaataccgaggaatacgctctgtaactttcaattctcaatttttaattcccctaagtatatgtcgcttgcccggaggaccgggaagacggctcatctcaaaaccagccgcttgcatacctctgcgtacctctccttttgcgcaataggttacgatcactccgcccggtgcggtatgagcatacaaacgattatagatttcttgattccacatctccggttgtttctcgggcgcaaatgcgtcgaaatagatcaaatcgatatcatccggtagttcacaggcgttactatttccttctattttatgaagtgtaaagcgctctgagattgaaacgggagtattccactccgcctcatgcaaggctaagaataactcttttctctccggccagatcagctctccataattcaagggacgaatcgtatctaaaggaagcgggtataactccacggtatgataatcaatatgatgtgcttgagatagctcgacatccttcaatgtcaagaaggcgttcagccctgtaccgaagccaacttccacgattcggataaagtctttctcccgcacatgcaatcccgcctcaataaatatatgtctcgattcctgcaacgccccgttcacggaatgataatgttcatccatcgccggaatatatagcgtatggcttccatccgccgttatctgtaattctttctccatatgtatgcaaagataatacatacgaatcagaataatacttatctttaccgctataaatatgatataagatatggatagacgccatctttacttcttactattcttattatgtaccatacaagccgctatcggtcaacagcgctccttctctatcaagggagttgtaaaagacgcatcgagcggacagccgatacctttcgctaacgtagtggtatggaacacgacgcaaggggcggtcaccgattccaccggattattcgagatatccggcatatcacccggaagctatcgtctccaatcctcctttctgggatataagccattcgttaccgccgaattcagactagcgaataaagatatattcttcccgatcgagctagaggaagccagccagaatctgcaagaggttagcgtagtagcctctccgttccgtaaaaccgccgaaagtccgctaggactccgtgtaatcggcttcaaggagatagagaaaagcgcgggaggaaaccgggatatctcccgggtagtacaaacctttcccggagtagcgtccacggcagcgtttcgtaacgacttgatggtaagaggaggaggtccctcggaaaaccgtttctttttggatggcgtagagataccgaatatcaaccatttctctacccaaggagcctccggaggtccggtcggtattatcaatcccgattttatccgggaggtcaacttttattcggccgcattccccgcatccaagggaaacgctttaagttcggtattggattttaaactacaagatggaaataaggagaaattctcattgcgaggagtcctaggagcctcagatatcggtgtgtccgctaatggaccgctaggaaaaaagaccacttaccaagtgtctgttcgtcgctcttaccttcaattccttttcgatatgatcggcttgccgttcttacctactttcacggatgcccaattcaagattaagcactccttcaaccccaagaatgagcttacagttctcggattaggggcgatcgatgatatgaagctgaatacaggaatggaagacatgagcgagaaaaaccaatatatcctctcttacttgccggtcgtaaaacaaaaaacgtatacccttggagcggtttataaacactacgccggtaaaaatctctactcggtcattatcagccgtagccagaccaacaataagaatattaaatacaaagacaatgacgaaagcaaggaagagaatctctccttaaattaccgttcggatgagatcgagaataagttccgaacggaaaacacgttccgcttaccattcattcaattgaatgtcggaggaaacatcgaatacgcccaatacacgaatgacacctatcaaaagcaatttacctctatcccccgtaccatcgtatatcaaacagaccttggcatatggaagtggggtatctatgccacggctatttatgagagttataacgagcggtttaccgcctctttaggtgttcgtgcggacgcaaacaattattcctcggatatgaataatttgttagatcagttatctcctcgcctatccttatcctaccgcttgtccgatccgctttatataaacgcgaatatcggacgctactacgagcttcctccttatacgacattgggattcaaggataatgaaggtaattatgtaaaccggacaaatcatttaagctatatccgaagcgaccaagccggattaggcttggaataccgtcctacctcatacttgaaattcacggccgaaggattctataaacattatgatcgttatccgatgtccatactcgacagtatcccacttgcgtcgaaaggtacggactatggtgtcttgggaaatgaggccgtatcgtctaccgctacagggcgagcttatgggcttgagatcatgggacgttggtataattataaagggcttactttcatcgcgtcctacactttggtaagaagcgaattcaaggatgggagaaatatggacacttatcttccctcggcttgggacaataagcatctgttcacgtttagcgggacttattctttacccaagaactgggacgtaggcgccaagttccgggtagtaggaggcgctccctatacgccttacgatgtagaaaagagtagttatgtagaagcttgggacgctaataacgggctatactatgattacagccggtttaacagcgaacggctcaagccattcacgcagttagatatccgtatcgataaaacattttacttcaaaaagattatgcttggagcctatatcgacatccaaaacatattgaattccaaatacaaagagcaagacgtatatatcaaaacgggtaaaattatcaacccggaagctcccatatatgaacaacggtacgaattaagaccgatagaacgtcttacaggaacgcttctcccaagtatcggagtgatgatcgagttatagattttaggcgtaatagattctttttattttgaatttcagcaattaatcataaatcttttctatttttgtggactgtatgaacaaaaaatagtactttaatcgcaaataagcacatgaataggtaggtaaagaatgacattattaaaatactacatacgattcgtactctttatcgtgttaagtctggtcttttctttccacttatacgctacagataatgcaggccctattttaatcattagctcctacaatcccgatacacgtaatacgaccgccaatatttccgagtttatggaggaatataagcggggaggtggtatctcgccggtggttatcgagaacatgaactgtaagagcctcccggaagcccccttatgggacggtaagatgagaggtatattggataaatataaggaaaataacactcctcagcttatcataatcttaggtcaagaagcgtgggcttcttatatctcccaagaatacaagcctgatataccggttttatgcggtatgatcagtaagaatgcgatcttattacccgactcggatttaaatgtcgccgaatgggagccgaaatacatcgatatccaagagtacgtagataaaggtttacatcttggcggattcttgtattcttatgatgtaaaagaaaacatccggttaatacataagctatatcctaaaactcaaaatatagcattaatcaccgataatacctacggtggtttagctatgcagaccttggtaaaaaaggaaatggaaaatatcaaggatctgaacttgatattactggatggaagaaagaataatatctacaccatcgttgagcaaatcaagaacctgccggatcagaccgtgatattgattggtacatggcgtgtagacgtgaacgacgggtattatgttggaaatgccacgtataccatgatgaccgccaatcccagaatcccgacattcacattggcatccgtcggcatagggcactgggccatcggaggtttcagtcccaaatataggcctataggttccgatttggcgaaagaggctttaagtatattggagaagaaaatcgcccctaaagatatccatccacaaatcattcccaatggatatatgttcgacgcttcaaagatcaaggcttttgatatcagcagattgtcattgccccacgacgctactattatcaacgaggacccgagcctattctacaaatacaggttcgagatcttgctaagcgtaatcaccgtattgtttattttcctgataatgatattaatcttctttatccgaaccaataaactgaaagataagttattggatctacagaaggataatatactaatcatgaataatatccaagcttccatctatttcatcaagccggattataccgtaaaatggagaaatgaggtagagttccatgactgtatccctgaattcggtccggctaattgcttcttggtcaagaacggagtaaagccttattgtacccgttgcacggtcgcaaaggccatggaaaccaaaaagcaggtcgatatcacgaatgagttcggcgatggaaagtatcttcatattttggcgaaccctgtattagacgagcacgacaaccttatcggggttattttcaagaaagaagatgtgacaaaacaaaaacaggcggagaacgaactgaggaaagcgaaagagaaagcggaagagtccgatcgtttgaaatccgcgttcttggcgaatatgagtcatgagattcgaacgccattgaatgcgatcgtcggtttctccggattattggccgtaaccgagaatatggaggataaagaggaatatatcaatatcattaatagcaacaacgacctgctattgcaattgatcaatgatattctcgatctagccaagatagaggcgggtacgctagaattcgtggattcagacgtagatgtcaatcaactattctccgatatcgagcagtcttcccgtttgaaggcgcaagatggtgtgcaggtatgctttgtcgagaagatcccgaattgtatcttacgcaccgaccgtaaccgggtctcccaagtcattacgaactttatcaacaatgccatcaagttcacgactcaaggtagcatcctgtttggctaccgccatagagatgatgagttgtatttctatgtaaaagatacaggatgcggtatcgccaaggataagatcggtcaagttttcacccgtttcgttaagttaaatagctttgtgcaaggaacggggctgggattatcgatttgccagatgattatcaagcgtctgggtggagatataggggtggaatcagagcaaggaaaaggttctacattctggtttacgttgccctattcgatactagagatgcaggaagtcccgcatgagaaaccaaaaaccgagaatgtacagaagagccagtcatccaaatcggcaaccctattaatagcggaagataacgaaagcaactatactttattccaagccatgttgaaagattataaccttatacacgcatggaacggggaacaagcgatcgatttattcaataaatatcaaccggacttaatcctaatggacctaaaaatgccgatcgtagacggctatgaggctacacgggtaattcgggaaaagaaccagtccatccctatcatcgccgtaacggctttcgctttcgcggaggatgaggaacgggtaaaacaaagtggattctcctcttacatcgctaaaccgatcaagccggataagctaatcgcatgtattaatacttatttatagaatccgtttggtaacaatcggaaaacgcaagacgaaagaggaacccttctctacttgagagtcgagactaatacttcctccatgacggttcatgatctgccggcaaagacttaatccgataccggaacctttagatttagtcgtgaagaaaggcacgaagaccttgtcgatcgcctcgggaacaattccgctaccattatcaatcaccgaaataataaccatgccggctttttggacagcctccacgactatttgaggagataaggactcttcacaagcctctatcgcatttttcaatagattaattaatacttgttccaccatgatccgatccgcatataaattcaaatcttccggttttacacgaaagaagaggatgtcggacttctccggaaatagaagccggatatcgtcaaagagagccgaaaccgagaagtttcgtaaagtaggtaaaggcagacgggttaattgccgataattctcgacaaaatccaatagccccttacttctccggtggatcgtttgcatggcttgtaccatgatagcgtagtctctctcattcatgccatttatcgtcgcacgctcggctaccgtctctgataaagagattaccggagcgatcgagttcatgatctcatgcgtcaatacccggataagtttctgccatgcctcggtttccgcctcagcgaccaccgaattatacaatcgactccgtaaagcttccaaggcagcgttcatagaagaggccaaagccttttcgtcttccgtcattgaatcggaaggataaaacaggctcagatccccgtaatgaatactctctatcaggtattccatccgcttaacagtcttttgctgatccttatataagaaaaccgaaagcgcaagaatacaaaatccgaacagcgcaggaataaacaaaaaccctttcagcattaagaatgaggcagtaaaagacaagaccacgatccccaaaatacgagcgaacaacaagtaacgtatcataagccaaatttctccaatttacgatacaaggtaaagcgggtaatccctagaagctcggcggcacgagtgatattcccctcggcacgacgtaaggcacgttcgatcgcttctttctccaataccgtcaaatttaactcatcggatggttccttatccctaagcgggacagaacgcagaataaagtcttccggccttagccaattactttcagacaagataaccgcccgttcaatcgcatgttgcagttcacgtacattaccgggccaagcataattatgtagcttattcttcccatccctgttaatgcccttcaagtctttcttatatttacgggcatacttcgacaagaaatgttcagccaataagatcacgtcatttcctcgttccctcaagggaggaatatgtaactcgatcgtattaatacgatataaaagatcttgccggaaagtaccttctgccacaagatgatggatattcacgttcgttgcgcagatcaaccggatatcaatcggtatgggttgcgttgctcccaagcgggttatctgtcgtttttccaaagcggtcaacagtttcgcttgcatggaaaggcttaagttcccgatctcatccaagaacaaggtaccaccggaagctacctccattcgtcccggcttttccttacgggcatccgtaaaagcccctttctcatagccgaataattcactctcgaaaagttgttccggaatagagcccacatcgatcccgacgaaaagattccccgaacgcggagattgatgatataaggcgcgggcaactaaatctttaccggttccattctcccccaagattaatatattggcatccgtattctttaatttatcgaccgtagcgaaaatagcctgcatcggttcgctttcaccgatgatctcgaagccagcatcctcgggtgaactaagaatctcaacttgtttctttaaatttcgcacttccgccctactctcccgaagttccaatgccgaagagagtgtagcgagtaatttctccttttcccaaggtttcgggataaagtcggtagctcctgccttaatcgcccgcacggccttatccgtatccgaataggcagtcataaaaagaaccaccacgtccgggtctatcttctttatcttctccagccaatagaaaccctcctgaccactaatagcatcccgtttgaagttcatatccaacaagataatatccgggataaaagtccgcatgaaatgatcgatgcgctccggttgcgtagccactcttatttgttccatatagggctccagtaataagttaagggcaaaaaggatgtcctcattatcatctataattaatagttttccctttttcataagcgctaaactagtttgtgatgcctcaaaggtaggtattaaatcaatggaagaagcgtgcgtaatcgaacgattatcgtgcgcagatgaactgttaaattaatagtccgcaaagagggttaagattaagtaaacggtaagactatttaagcgaaagaaaaaacgaggagaaagaaggaagactatctttgaacacaattaacaattcaggcattcatgagaccactattgattggatttttcgtctgtataaatatacacttaggctatgcgcaatggactgagcaagattcgatctggctaaaggatgtattagcaggcaaagattccatcaaattgaaccctgaattccaaaaagcaatccaaagcggttctttcctcaacccggaaccgggaaaaccgatggggaaacctcaactggccgctcccagcaatatccctatcaccagagatttctcagaatatatccaacaagacgatacgacacaccgaaaagtagcattgaaggatttaccaccatcggtattctggcgacataatccaccgtataaaaagatactgcctgtctatcaatctatcttagatgaattgaaaaggactccgtccagtggtcgtacctcactagcaaccttcgatctaggaaggatgaccagccggaaaacatatgtccataaacgcaacgcaaaacgcaacggaacttggcaaaactacggcaacctccctaccccggatgtcatctctaaaaggaagaaattcgaaagacaacaggcagaggccgcaaaaaaggactcctcattgatgatccaaccaccaatcgattagcttacgggccaagctcaacttacggggatctccggtaagttatctttggtatagaaggcaccagaacttagttcctcatcctgcaacttaatttccccacttacataatccgctacaaagcctaccatcaagccactcggataaggccagggttggtttccgaaataagtgatattatcgacctctaaacccgtttcctcacggacctcccgacgcacacactcttccaaggtctcgccaacttctaagaatccggccactaatccatggaaagttccccggaaattacgggcatgtaccaaaagaatcgaatcctccttacggatcaagacgatcatcgctgctgagattgtcggataaatctcatgtttgcaagaaggacattgcttcatgatcgacgtagtctgcacggtaggagtaccacataccgggcagaaacggctatggctatcccaataaagcaattgaaaagccttacccgccttctcgtaacacgctctcgagatataatcccaagaggcacgcacccccatatgtacgtaacggtcattcccctccaccggagtatccaattctgccgtacgcgcgggaagtccatcccggtaatcaacctccagcgtatgagaaaccggaactgggggattctcgccataagggatggtatacgtatcattctctttctgaagcaacagttggtctttataaaaaaggaaccaataacagagtttatttgaagtttccatgctgatatttccgaattatctttctatatgtaaaacatccgcgaacttacgaattaaaatcaaataacgtgcgaaagcgaacgtgcaccgtgcgaaggcacacacaatcgtttctaagcatttttctattatcttatgattagcagaacgttacatcgatggcacattatttgcctcttttctaaaaaatgaatatatttaaaacctgttacaatgaaactaatgattcgaaacttactttatctattcaagcggtttaagaccgccgtcgtgttaaacctcttcggcttgacaatcgctttcgccgccttcctcctgatagtaatgcaggtggattacgagatgaattacgatgccatgcacagtaaatcgggccgaaccttccggctagaggcaaatcacggagaattcgagcataacgccatccattgcctaatgtttagcgatgcttttgttaactcatccgctcatatcacggattactcctaccgttatccattctacggaggagaacggtattgccaaatcgacgaggtagacgatcaaggagaagcgaaagtatttaaggaaaacttccagctttgtctacccaatatctcagatgtctttgatttccacatgaaagaaggttccgtcgaatgcctatccattcccggttccgtactcattccggagagtgtcgccaaaaggctgttcgacaaacaatccgctatcggtaaacgtatccggatgtccggcagtagtggctggcaacctgtaagtaccacgatacttactattgggggtgtctataaggatttcccgggaaatactacggtacaaaaccgtatttacgtcccgatggaccaactgggtctattaaaaagttcttggcaaatgtatgccaacgaaatatacgtcacgctagacgaccccctaaataaagaggaggtattggatcatttcaacaagactttcgatttcgctaaaagccaaatgggttcagcgcaagagatcgcattacgtctaacccccttaaaggatgtttattacacgcatgatacaactttcgactttaatccgaaaggtcaccgggagacaaattatgtgttactgggtatcgctttcctcatcttattcatcgccggaatcaattttaccaatctcacaacctcgttgattcccctacgattgaaaacgatcaatacgcaccgggtattaggatgctccatctataagttacgagccatctcactgattgaatcgatcgtgatctgcttgatatcctacattctcgccttattcatcgtaaacgatttgtcttacacaccgatcgctaattgggtagatgcggatatacgtcttagtcaatacaaaggcctgatccttctcacagcactgatcgctatcttgacgggttgcttggcaggactttatccagctatacgaagtacctcctatgcgccggccttggtactaaagggctctttcggtcttagtcccaaagggaaaaaagtacgtgtcgccctgatcggtttccaatacacggtatcgatcgccttgattattgtcaccttattcatgggacttcagaaccatttcatgacctctagcgagcaactaggattcaataaagaccaagtagccatcgtgaacctgacaccggagatctacgccaagcataagccccaatatatccagaaacttaaagattatccgggaatagaggatgtggccttctccgtctacgaattatcgaaagaagatgacatgatcgatctcgaatatgcccgtcatgaagataaggatgtattcttcaaggtattctatgcctccgagaatttcctttccgtcatggatatccaagtagaggaaggaagggattttacacgggaggatttaaacaaggcacaaagtgattatatcatcaatccggcggcagagcgggatttccacttacatcccggagatcgtttcaatgatcgtacggttctaggagtcagcaaggatttccggtttaactcttgccggatcgcaagctcgcctttcgtattcgcattgaataacgatatacccaatcctaaattggtatcctatatccgcttcaattcgaaaacgaatttacaggaagctgtcgcccacgtccgggaaacattgaaagagatcgatccgactttccctttcgagatctctttctacaacaccatcttaaacaatttatatcagaaagaacaaacactgggtaaactaatctccctattcggaataatggcgatcttgatctctatcgtaggtgtattcggactcgtgctatttgagacgcaataccgccggaaagagatcggtatccgcaagatcaacggagcgactaccggacagattcttttgatgttcaacaagacttatatccggatcgtctccgtttgcttcatcatctcgatcccaatagcatggatgggaacacaacagtggctagagaatttcgcttataaaacaccactccatctttgggtcttcatcgtagctttcctaatcattctctcggttacgatcggtaccgttactttccggaactggcaagcggcgaatgagaatcctgtgaactcggtgaagtctgaataaactcactcggagtgatcccgtaaatttctttaaagcaacgggtaaaatagttcggatcggagaagccgacctgagcagctacctccccgatcgaataagcgtgctgccccaataactcggcggcacgctttatacgtatattgcgggtgaatgaggaagcggagcaaccagtagtagactttaatttccgaaataagctggcacggctcatcgccatctcggaacagaaaagctctacatcaaactccgggtcctgcaaatgagccagaacgacctttgtcactttcgaaacaaattccttatccggatcggcgatggtttgctccggagtacgcaagtcgaaccgatccctgaaatataactttagttgctcactacgtttgagcagattcttgatcttcgcttttaagacagcaagactgaacggtttaggcagataatcatccgctccggctccatacccttccaattgttgacgttcttccgctaaagcagtcaataggataaccggtatatgggccgtccgttcatccattttcaaagcctcgcaacattcaatcccattcatgaccggtatcattacatccgagacaatcacgtccggtaggatctccatggctttctccaagccgacctttccgtttttcgctatcacgacccggtaatccgtttgaaaagcattcatcaaataacgacatagatcctcattatcctctacaaacaaaagcgtttgtcgtagattctccgggaccgggtttgttccttccaatggaactgattcccgcaaagatgcctcttccattttaggttccgaatactccaaccactcctcaggataagcctcttccgatataggcaaggcaaccgtaaaaacagaacctttccccaattcactctcacattgaatggttgccttatgtaactccaatagctcttttgtgtacgcaaggccgatccccgaactctccgagcggcgaaacgctatcgattcccccttataatattgatcaaaaatatacggtaacgattcggggggaatgccgattccactatccgtaattcgtaaagtcatgaccgcatcggatgagctttgctccaataaagcggaaaagcttaccgaaccaccatccggcgtatacttaaatgcgttcgacagtaaattatatagaacctgctctaggatattcttgtcaaaataagcgattgagatatctggggcaatcgaatacgtaaacgcgattttataggaatcggccaaaggaataaaggtttccgaaatctcctttaagaatcgactgagatccgcacaaacaatatgcggggaaggaactccccgggtcaataccgataaatccagtaattcattgacatgccgaatcaagcgattggtattccgggagatcgtacgcaaagtttctttatctccacaagattcttctgaaccggaatgccgttccagatcctccgtcaatcccttgattatcgtcagcggggtacgaagctcatgagagacattcataaagaaacgagttttcaacgcatctttttcctccagttcttgcttggcctgtttcaacagccgtgtacgttcttgtatcttacgctccaactcggcttggcgaagctgataccagcgcacccggctcttataggcgatatacaacagtacgcatacaaccacgaataccagcaaaataaaccaccacgtccgccaccaaggaggaaagatcctgacaggttcggtaatgggagcgctccaataggaaccattgccggaagtttccacccgaaacacatagtttcccggtggtaggcggttatatatagccgtacgatcgctggcgtccacctcccgccaatccgtatcatatccatccagacgataccggtatcggatactacggggatgagaataatcgaacgcaataaaacccacctgtaaaccttgcttctcacgtgagtctccgatcgtgaggttcgtgattcgcaaagactcaggtatttttctcaaaccgtccgttaactgaacgggatcaaaagaaacgatcccctcattactgccaaatacaagttcacccgatttgcgcttacagcaagcgccacccataaactcattcgataataaaccgttcgccgtcgtataattaacgatatgccggttttgtatatccaagcgactcagccctttattcgtgctgacaaacaggatgcccggctcaccttcacggattcctcgtacgatatttcccgataagccatcctgtaccgtgaaatgatcaaatcgcccggttcgcttgtcgtattgatccaaccccgcattcgtaccgatccacaaataaccggaagagtccacaaacagacaatgaatatgattcgacgcaaggggattcatctcacccggtatatatcgatacgtgataagcgctctcgtcttcgtatcccacacccgaagccgcccctcatccgctcctccccaaaaccaagactcttcgctcacgcataagttacataactccgacaacgagttgatcggataatcataagagacttggtaatccggtataaaagggcggattcggaaatcatccagattcaaccggtccgggttggcgtcttgataactgatccataggttccgctccgaatcctcacggatagaacctataatctttccggataaagaggacggactttttcggggtgagaaggtaaaacgcatatctacccgggaagtcttatggttaatccgatctaatcccctagaggtcgcaacccaaagattcaggtccgaatcctcataaacggctaggatatgaagagaagacagattctctttttccgtgtatcccaaggtatatcgaaacaaggaaggtgttaaatccgcatggctcaccccatacgtggaatgccccgcccacagatgatccgagtcatccagaaacaaacaggtaatctggttactgctgatagaatgtgcgtcttccggcacgttcctcaactgtcccattttcctctccttcggagaataataaaaaagaccttgattgaaacggctatcatcaaaccagaccgttccgtccttactctcgaagatggatctcacttggcattctcccgtaggttccagatcctccggccggtcaaagaaatgctcacatcgcaaggcaagccggttcatccggctaatcaagcttgcccccttattatgtccgatccagaaatcaccatcaccggtctccaagaattgatatacccgagtatcctcacgaccgacagattggaagatctctcgctctcccatatcaaccgaacgaaaagccccttcacgtcccgtacctaaccacatataatcaaaccggtcgatatagatcgcgttaacgccattcaaattgccggcattgatatcctcccggtcatttgtccgtatcgtataatcttgaaagtggtttgtttctttgtcatacaaactaaaacctgctaaagtccctacccaaaacgaatgatccggtgccgaatacaaacaattcacaggagacgacgagactaccgaacccgccggcgaaaggcgtaccaatttcttctctttagcgtcatactccaacatcccgttctccgtacctataaagatatgtcccggaacggaggccgagaaacaagtaggactaccatacacacgtaactgttgtcgaagccattctttcgtgaaattcagaaatgtatccgaacctctgtcataacggctaatcccacccgaggaaaaaaagatccagatacctccatctgaatcctcgaataatttatcgatagaactgctttgtatactttccggacaatccggtacgggcaagaatactttaaacgtatatccatcgtagcggttcaagccttcagtcgtcccgacccagacatacccggtacgatccttcaaaatagaggttaccgaggaagaagaaagcccgctatccattgttatccggtcaaaaataacgttggtagcttgcgctctcgttatcataagtacaaacagcagtaaaaggtatattctcatccattcatctgattaaagccccaaatataaagattaagtaggtgaaaatcacagaaaatagaaagattgaacgatttgtacggtattatgaaacatatgtccggcccgctccctccctatttccctagctttgcggtatcaattctaaaacgaatgtaaaatatgagaaaactttttctatcgctagtattccttagcgtgctactatctatccatgcgaatccgggtattaaaggaatcgtaatcgatcaaaccacccgtaaggcattagactacgctcacgttgtattatatgatggagatcatatcgtcgaagaagctatgactgaagcgaacggttcttttctaatccagcccgtaaaaccgggaacgtattcgatccgtatccattttctgggatatgatgtttatatgggagaggagtttatccttacagagcaaatcaaggatctgggtattatcccgatgcaaatgcttgaggtaggcttacaggaagtggaggtcgtagccaacaagaaacaagtcatctataaactggataaaaagatcatcgaggcttcttccaacctgctttcctcgggaggaaccgctgtcgatatcctagagaacacgccttccatccgggtgaacgccgagggagaggttaccttccgggggagtagcggattcacggtctacgtagatggaaagcccagtatatttaccgggacccaagccttggaacagatcccgtccggacaaatccagaatatagagatcatcaccaccccgtccgcccaacatgatacagggggtgatgtcgggatcatcaatgtcattaccaagaagaacttcggggaagggctgagcggagtaatcaacctaagcgggaatacggtatggagccggaccttggatttcttgttgaccggacaaaacaaggcgtctcaatggcgtataggcggttatgtgggaaaccgacttcgcaaaagtcattttacccaagagaaaacgacgttggtaaacgatacgacaacgacttcttattccaatggcccccgtgaaagtaacggctacgcatatattctcaacggaggttggagctatacacaaaaacaaacgactttttctattaacgcggaaggcggatatgccggactcaaacgaaaaggggatcttgaatatacggaagaacgttccgctaatggcgagcaattcgagaacggagagttcaagagccttgacgactttgatatccatgagactttcggactagggaatctggccgtggatcataagttcaatgataaggggcataaccttagcggtagcttcttcttgaaatatggaggcgacgctctggaatatttccaaagcgatctgttcgacaaaaacaacgtacgccagcaaggtcatcgtgcgtgggaggccgaacatcgttggaccgtccgtacgaaagccgattatgtatttccatacagcaaaaccggacaaatcaaggcgggttatcaatatttctcatactcggaagacggcgattatagtatgcagttttggaacccggataccaaagagttcttctggcgtgacgatatttacaacacgttctatttccaacaagggatcaactccctttatgcgatcgttggggatagctaccggtcttttgattttcaagtaggattacgaggagaacatacgcatcaagtattacgtagctccaaagattgggcgaaccgcctacaaaggcgttttgagttgttcccatccgcccatatcggttataacctcacacaaaatcagaagcttctattcgcttacagccgtcgtacgacccgaccggagctttatttcatggagccatacatcacttacaaggattactatacagccgagatcggtaacccggatatacgcccggagtacattcattctttcgagttgaattattccttgacttccggcgacaatgccttgtctgcctccctattccaccgaacccgcaaagacaagatcgaacgattacgggttccttaccaagccggggttaccttggattccatggcgaacgtgggacatgattattccaccggaatagaactatcgggcagtttgcaggccaccagttggtggaatacgcaaataaacggtagcctttatcactaccgggtagagaacgagtataagacggacggaaagaatgagaccagtaccaattacgagatcgcttggaacaacgctttcacggccgggaaatacacaaggatacagcttgacggcaatttcgtaggtccttccgtaaccacccaaggaagaacccagtcgttctgttttgtcaacctagcgatacggcaacaattcttcaaacgaaagttgacggccaccctctctttccgggatgtcttcaatacggcccgttatgtcaatacgatcacttcctcgaacttgatttccaaaacacgaatccggcccgattacccgttgataggcttgacccttagctatacgttcaaccagttcaagctaaagaatggcttatccaacaattcaaaggatttattcgaggggacgaatcattaacacatacctattgctccactttcaaagtatgttaagttactttgccgatgaacttaacatactttgccgatgaacctagcttaatttgccaacaaagttagcctgctttttcctatctattttcactgtattggaaacctctgactataaagatattataataagcatattttgcaatttaaaacggtttgacataatttccagctctccaataatataaatacagaaaaaaccattacttttgcaacctatgtgtaaaacaaagaaggaaattgtaaagtaaataacctcagacgttcctgtcggggttatcccaccatcatactcgggcatattcctgcccgagctatttttcatatacctttaggaattaattaaagcttgacaaggtgcgttatgcatttgttgaagttcttaacatacataatacaatgaatttaaataatattcaaataagagaaactgcgacaagcgattttagccatataatggaagttgagaaattggcattcggctatgataaggaagccgaactcgtagcagagttattagccgacaatacaaccaaaccgatagtctcacttcttgctttttataaagacgagcctatcggacatattctttttaccagagcctatttcaacgaacagcagcagcaaccgatgatgcatattcttgcacctttggctgtaaaaccggaatatcaacggcaaggtattggtggaatgctgataaaggctggtatagagaaattacaagaaaaaggttcaaaccttgtgttcgtattagggcataaagaatattatcctaaatatggatttatacctgatgccaatcatttaggttatcctgcgccttatcccattttggaagaatatagtgattattggatggttcaaccaataagcccaaaaggattcgaaatcggtaaaggaaaaattaaatgcagcgaagaattaaacaaacccgagcattggcgaaatgaagaatcagatagataacttttaataaaaaacatcatgagtaacgaaaataaaacaattcacgaattcgatttcaacctgatctgcgaatacttttcaaacgtagaacgtcaaggaccgggcagcccagaagcaactcttaaagcgttgagttttatcgacaatttggctgataattcccgcattgccgaccttggttgcggtacgggagggcagacaatgattttggcagagaacgctccggggcagattaccgggcttgacctctttcctgaatttatcaatatattcaatcggaacgccaaacaatctgacctttccgatagagtaaaaggtgttgtaggttcaatggacgatcttcctttcgggaaagaatccttagaccttatctggtctgaaggggctatcgccaatatcggctttaaaaaaggcttgaattattggaacggctttctaaaaaaagacggttatgtcgccctgacctatgagtcgtggtttacggatgaccgccccgccgaaatcgaaaagttctggcttgacgcagttcctgaaatgaacacgataagtcataatatttcagtcttgcagaaagccggttatcgtcttgttgccgcatttacgttacctgaaacctgctggacagagcattacttttctccatgcagcaagatacaggatgagtttctgaagaaacatgcaggcagcaaaaccgctgaggaacttatagccggtcaacgccatgaaaaggtgttgtatgacaaatacaaagagttctatggttatgtgttttatatcgggaagaagatctaattaactcaaagagggaagattatcgtaaaacaatagtcttcctctttcaaataaaaaataaaatgaaaaagataaattactattatctcgttgctggattcttagctctcctgttttcgataacgcatgagctaaacggacaacgggcattaattcctgccctgtatgccggggaattagatataaataccgtaacgacattcaagtatatttgacatattattacggctgagaacagtgtttttggtattgctttcattatcatggcattttataaagaacaggaaaaagtaaaatttaccgcatgctgatttgtgcgatcttgtacgctgatggggccttataaacaaataagtacattaagccaaaatgtagcgaatctgagattcaaggtattgctaaacgagaaaatagcggagaagatattagatgggataattcatttcggcccaataaatataccaagatttcgacttattgaaaaacgctatagccgagccatagaaatgcacacggaaggaaaagcttacaaagaaatgatccaaacactatatttcctcgatgacgatctcaacaatgatacttaccagcaacatataagtatcgaaagatacttcattaacgcagggttcattgatgacaagatcgagtatttaaaggataaatcaggattatctttgaatatattctccgctttttactccttgcagttttgttcatagtgctattgaaaggatataaatactatctacagcacaaaaaggaaaaaacggaacttaccattaaaaacgaacaggatcaacgcgcctttataaggttcttcctacaacatagctctgacaccaaacaacaatagcaaaagaaaaagcagtaagtagaaataaaccaactccaataccctgataaattaacttcatggacaaacaaagccggtaacctccaaaagtaagccccgatcaaacaaacgaccggggctaattctttatccgctctccatcctcacggaggtacttacggatgaactttaatttattactttagtattaatattaatcgctcccgcctgttcgcccatcacggggtacttggaccgaggccctcacgggaacatgattatcttatttcattattcctttacatgtcttatttaacgacaacctttacggtctcctcgccaaccgtcacgagaacgataccagcgggaacagcgatcgtcgcatcatcagaagtgataaccgtctctgccaacggcatacccaacaagttacggacataagccgtctcgccttgagcgccttggatcgttacataaccggcgttgcctgttactacgatagaagaagatacggaattatcgatagactcgttagatgtaggattaccctcgcctactgttagcggcaacgctttagaagcattagtagtaaagcctaatttaccgttcaacgcatacaagtaagtagtagcggcacctaccggcgtaactgaataaccaccctctattttcgtgatatagaacttgaagttatcgatgcctgctgagcaaacattttccttagtctctttagccactaccacagccttaccgttcacggtcgtattgatcgtatccacacctgccaaaactgccgggcggaagatagccttaacatccgtttcctccgtaggatcattagaataagagccttccaacgcatagttagcgtttacgtcaaatttagccttgctttcgttccagaaatacatagagtccttagcataatacaagaagtttctggtaactgcggcaggttcttccgctttagtaacaggttcttcggtagcgatgcccttagagatatagaaagaagggatctcagccttgctgtctgccgtatccaaccagaaagtcaagccctccgcgccaatgacaccttccaagataccatttttgttctctttcaaggagattgagccttcatcaccgtccaatgtagcgtgtctcggggtagcctccaagctgatgcccaattgatagaaatctacggttacattcgtataagatttatccgcacctaccaaatcttccgagaaagaagcttcagttacatctacgtataatctcttagcgccagctttcactacttggttataattatcagccgctttctccgcattaagctcactatccaaacagattacggaataagttccatctacgttcttcttgaataccaaacgagataacttctctgacttcttatccttatgttctgccaatgcgtatttgctgttatcagtatcatgtttgaagccattatctccatcaaccagataataagcctgtatagtcaacatatcagcctctttctccgcaacggcatcatccttcaaatagatatacttgaaattgttcttcacggactcagccttctcgaaagcccaagagtagctcttagcgacatcactaatcggctcaaattgctttttcttagcatcgtcattgtaatacatgtacagtttatcaacagccacggttgatttaccattgaataccaactgagccttttgtttcaattgagcgtctgtcaagttcaagaagccctcgttaccgcttacggctaccaatttgatattctccgcggttaattcaccaaccgtagtacttacggcttgatagataccagccttatctgttttgtacaagtttgccttgaaagtctcgcttgtctcaagattcttgaacgtaacactacccatacccggcatcgcgataacaacccattgagcggacggagccttcaagtctacgtctttcggagcgacagcctcttcaacgaaagaataagaattcgttcttgccacgtcagccttagccgcatacttagaaaccaaatatttgccatataaagattcattctccttaccggattcaggctgcgtacccgtaaaatagatattatagatagcggcaccgtcagtcttcaacaaatcagaagcttttgcccaagtatcacccgttgtttgagccaaagtaagcttagcttcatcttttttagtagtgatataggtcttcaagccaccagcggtcaaggagtaagcgccgacgtaaacattcagatttgaaccatggttctcatccgtatccttcgtagccttaacacccttcatctggaccgtatactgcccacctttattagccaaatccttttctgaaacactatagatagcattcacgaaagcgatcttaccatctttcttaacattggttgagttcaacttctcgccttttacggtagtgaagccgaagccctcaccttgagtagcatccaagctaatgataccgaaaatagcgttcggattcaatacgatgaaagtagcggctttcaagttatccttagttttgccatcacttttagccagcttcaaaccggcatcgttggcgactacgaaacatacaccggaaaccgattccacacctaattccaattgctcattaaccgtagcagcgtcgatagcgaacatctgctccccaaacggattcacgtccggctctgaagcggctttcgggaatttgaaggagaatcctttaccggaaaggttcttgtttaagtcgtccgctgtcgtttctttagaagctttaagcattttagcgactttggaagaggaggacatatcgtatgccaaaggcttgtttccaagcttaatcacaccttcggcaaacgtaaaccagcaatagcccttctttaccgcatccgcatcaggagtgcccacaacgtcaccacttgtcgtaccatatatcaccttacccgcggcattcaacagttgaaaatagtccgtaccattttccgtcttcttaccacttaccgtaaacacttccgcaccagcttcgtcaaccgtagtgaaaccgtaacctacattctttacttcctctgattttaaaaagcttgtaacaactttagtatcctcattaggatcagctcccagatacaccttttccccattcgtcactttatcaagtgcttcataggttttcgcaggtgtagtttctccagcagcgaacaccgcccccgccataagcaagaacgacgcaaacaaagtagaaattctcttgttcataaatcgaaaatttaatattaataatagtgttaattatatatccatcaacccttttagccaatctcggctttacgaaaacgactagtctaaacgatcgtttagatcttgcgtttttcgagaggtacaaaggggagtttgtggaaggaagagcttgtttcgtaaaggatagcctatcctattgataagaaagcgaataagggaacaaaaaaatagctcgaaagggttgcagaagtcaaagaaacgcgtacctttacaaatgactaattataacgatcgttttcaacaatcattttcatatatataatataatgtacatgcgtacattataatagcgtactaaaatatctccttgcaataaataacatattcaatataaactcccccgttttgggcctcggaagtgaataactaacggcttgtcgagtgaataactaacggcttgtcgagtgaataactaacggctatacctagtggataacttacggcttgggaagtgaataactaaccacttacaaaccttttctcctaccgttgaccaaaggaatttcctatcatcataatgcccattataaggtctttacaataggcaatgtaacacctttataatgcccattgtaagccgcttataactgcgaccattagaacgctcaaaaaggacactgataatcaatacattaaaaacgccattaccttgtccagaaaacacgtacgacttttacaaaaaacacgtacatgttttctcggaaacacgtacgtgtttttccagaagcaaattccggtcaaaagcaacaaagattctgataaagccattatctttgttttaaaatcaatacataaccatgatgagacacttaaagtacttggcttttgtagcatgtctgggaagtctttccccagccttcgcgcaaaacgcctctaaaagcctaacagttgatgacctagtcacttggcaacgaatcacggaccgggagatctcggacaacggaaaatgggtagcttgcaagatggaaccttgggaaggtgacgctaccgtttatttgtatgcggcccaagggcaagagaccgccactttttctccggccgataagttcgcgttctccgcttcctcgggttatctggttgtcacgcaaacacccggaaagtccacggtagattccctgaaagtattgaagacgaaagaggacaagatgccgatgaacaccttggtaatctattccgtcgccggtaaaaaggagacgatagactccctcaaaaccttcaaattagcggacgaggcggattggatcgcttatcaaagaggccggaaggactccacgttgtacgtccgttcgctggatggaagcaagaccttccagttcccgaccgtaacggatttccaattcgccaagaaaagcggtatgctatattacacgagcgcagcggaaggagaagcaggtatattcaccttgaacccggagaaaggaagtccggcgctcatcaaagagggaaaaggcgtattcaaacaaaccacgttcgacgagaaaggggaacggctagctttcttatattgcgccgacaaagattcttcttacaaagcgttaagcttatggttatccgagcataacgctcccgcaaaagaaatcgccacccgtggaaacaaggctttccccgctgaatgggtaatcaatgagaacgggatgcttcaattctcgaaatctgcttcccgtctgttcttcggtacctcaccggagccgaggcaaaaagacacgacccaactagccgagaatcgtccgaacgtacaggtttggagttgggatgagcccgtacaatataccgtacagaattataacaaggaaaaagacttaaagaaaagctatcaagcggtttataatctgggcaacggctctatcttccaattggcgaatgaggaattaccgaatatccaattgggtaacgagggtgacgcagccttggcgctcctttccacttcccgtccctattctttgtcttccatgtgggaggcccgcacacgcagcgactattataccgtatcgctggataacggggagcgcaagcaaatcgcccaagcggattatggacgtttccgcctctccccacaaggtaaatacgcatattggtatggcgagacggatagttgctggtacacgatcgccttggcagaaggtaagcgatatcgcctaaccaccccggaaagcttcccggcttgggacgaggagaacgacgttcctaatcatccttatgcgcatggagccgccggctggaccgcgaacgatcaaaatctattgatctatgatcgttacgacatctggaaattcgatccgaccgcagctacctcaccgatcaacctgaccgtgaacggaaggaaggagaaactgtcctaccgcttggaacaactggataaagaggctcgctttatcgacctcggcaaaccgcaattattaaaaggattcaacgagaccacgaaaggatacggattctataacgcacgcctctccgctccagcagccccgaagaccttgctggcaggcaactatatgttgcgatctatcaacaaggcgaagaatacggacgacgtgatctatacgatggaaaccttccagcaatacccggatatccactattcgaccttggcgttcaagaaatccgtgcaattgacgcatggagacaaacagcaggaaggttttatctggggtaccgccgagttggtatcatggatttccttggacggccgtccactggaaggtgtcgtttataagccggcgaattttgatccgaacaagaagtacccgatgatggtaaacttctacgagcggaattcggagactttatataattaccgtatgccggaaccgcatcgttctacgatcgattatcacttatacaatagcaacgaatatgtcatcttcaacccggacattcgctatgtagatggttatccgggagaaagctgctataactgcttgatgccgggtatcaccatgatgatcgccaaaggatatatcaacgaaaaagggatcggtgcgcaaggacatagctggggaggttaccaagtagcttatttagcgactcgcacgaatttattctccgctatcgagtctggggcgcctgtcgtaaatatgtttagcgcttatggcggtatccgttggggttccggcatggcccgctctttccaatacgagcatacacaaagccgtttaggagctacgccatggagttctccacttcgttatctggaaaactcgccgttgttcacgatggataaggtgcagaccccaatattgatcatgcacaacgatgccgatggtcatgtgccttggtaccaaggtatcgagtatttcgttgccatgaaacggttaggtaaaccttgctggttactgaattatacaggtgaaccgcattggccgatgcatatggcaaaccgcatcgatttccaacgccgcatgttccaattcttcaaccattacctgaagaaccagaagatgcctaaatggatgtccgagggcgtacctgccgtagagcaaccgtttgagttggggtattgatcagacaattacagcttcatacgaaactcggtacggacaccgggtaaggaatcaacggttaaatcgccgccatgcaagcgcattatgcggtgggagatactgaggccgatgccgctaccaccggacttcgtagagaagaaaggcgtaaagatagcagacaatagttcaggagaaataccggggccattgtctgttatagttatatataccctaccatctgtcttcaaggcttctacggagacgataccatccgcttgcccctctatcgcctgtaatgcgttacggatcaaattaatcagagccaacacgatcaagttttgatccacacgtaccgttaaagcttccgcagaggagaaacggatacggtcgctacccggctcggcacacaacaaccgttccatcttctgaaataaagaggttataggcacctcggttctttccggctccgggagatgcgtcagacgatggtaggaatccaagaaggcggataaattttgcgcttgcccatgaataacctccaaaccttcccgtaattgcttcggagtatatgtatcggaatatttcaataggtcagcagacaaggaacggattggcgtaatcgaattacgaatctcatgcgtcagtacccgcaagatactctcgtaatataaacgcttctcttccatctcactctggttttgactgaataggaggataatccggttcatttccgtatacaaatcctttacaaaaggatcattcgttttatttgggtaccgcaaagctgtatccccattacgaaccgactcaaagaaggtagctatcttacggtttataccgttcatccaccggattagtaacagagttatcaacaggataatacacagacatacaaaggataagaagtaagaggtaccggttatcaacaatacggacccaagtaacgcgagaaacacgatcaaggagacgattcctataatcttcaagtataaactccggttaaccatagctactctccttataatctacaatccgtatttccgcatcttattataaagggtctggcggctaatatccaattgttgagccgcaagcgtcaggttccctttcttttctttcaatacctcggcgataaactgccgttccatatcctccaacgtacaaggatgggagacttccgaaagctcctccacatagaaatcatcggcatccaaacggcatttatccacaagtaagaccgtacgttcgacgatttgctgcaacaaggccaaatcaccccgcccggccatatcggataacttatcgaccgcctccgctgtcagacgaggcaatggtttcgcataagcctccgtatatttctttagcaatgcattaataagagattcggccacagatgaagccttatctgtatttgattccatacggtgttcccacacatggacaagggtttgaataagtttctcgttatcccaaggtttcacgataaagtccgaggctccccttttaagggaagatacagccaactcgatatccccaaaagcggttatcaagataacggccggaggattcttaagctccaaaatacgatccaaccagaaaagcccttccccaccgctttgctttccagcgccgaagttcatatccagtaaaaccatatctacatctccattccgtaaaagggcaggcaatagaacaggagatgatacggtaacgatcgtcttaaactcatgggacaggatcgtccgcagacttctcaataccgcctcattgtcatctacgactataatcttcgcgttacgcatgaagcctcctcttttttcgcacgcaaagatacgatcttttcccggctctcagtgtccaatatttagacaaatccagtcctttacgaacgtttcctccgattttatttgccatattccacgcaaccggatagctttgaaccaacaaacagataaaaccatggaatccatatctctaaaacttatattccgtagctggtggcgaaacaagacgttcgccgtcatttccttattgagtctggcggcaggcatcacttgtaccaacctactgatctcatacgtcatttatgaatctaggatagaagcccataatcccaataagtcgcatatcatctatatggcacaagactctcccttgacctccggagagaaagtatcttttattaaagggaagatccctgtgcagctaaaagaccaataccctgaagttgaggattatttacgactgaacatagacaatgccgcctccatcacgataggagaaaagcgcttcgacccaatctcgatcgtcagagctgatccctcctttcctcgctttttcccttacaaggtaatggcaggaaatataaacaaggcattaacccaaccaaacgcaattgcgttgaccgaataccaagcgaagatattcttcgggaacgaggatcctatcggtaaaaccttttcggcaaagtacgcttatgagaacgagacgattacctacgaggtcgccgccgttatcaaagagtaccctcaatcattcttgaagttcaacgcattggcaggtactacctcccaattcaatggcggccctaccttattactggtaaacgatctcttcaacattgatacgttcactcaaaaactaaaggatgataaggtacctactttcaacggaaccggacagtattatttctataccctccaagagagttatttccaagagcaaacctatacacaagaatacatcccctatatccaccgaaaccagaaagacttactgtacgttggtttgttctcagccatcctaatcctcgtgatcgcctgtttcaattatgccaacctaagtttctcccgcattttgcaacaggtaaggatgatctacacccagaaggtgatgggagcatcggctgggcaaatccatcgccagctattcttggatactttccttaccgtgctgatcgctttctttttatccttgttacttacactagatttcctgccggctttcaaccggatcgtttccggacgtatctccttgggatttttctttagtggacaggtcttacctgtgatcgtggcactcatcctagctctatccattatcccctcattatatatgagccataagatcaactccctttcccattccgagtataaatcattcaccaccggtacccggaagcggacaatcataagcgggctctccatcttacaattcgccatctcaatagctctggtattcgccacgctaaccgtacggcagcaactaacgctcactcagacaaacggtgaacgttaccgggacctcatcgaaatagccgactggagtgggaatcatatacagaccttctctgaagagatccggcgttatccttccatagaagagatgtgcctttcgagaagcgggatcatacagttcaacttgcggacaatggtcttgaaagacgaaaacggaaacgaactaaattatacgctaggccaatacgaaggtgatagtactttcctaaaggttatgaagataaacattcttcaagggctctcagagcgagaggctctaaaacaatacagcacacccgtctatattaacgaacaatacgcacgtttgctcgtgcccaaaggcgagaatcccgtgggtaagcctgtccgcctttacgacactgaattcgggaagatggaaaaggagggagaaccgatagcgattatagcagggatcgtggagaatctatatacaggaaccttacgacaagaggtttaccctagcttgacctacctaacgcatactcccccctataacctcgtccaagtccgactgaaaaaagagcacagagccgaggctctagctttactgcaacaaacatgggaaaagatcaatcccaacgtacctttcgaataccaagatatatacgaggaatttatgttatctaaccgaaaaacgatcgaactggcacatttgctcatcatgtactcgatcatcagcctcctgctaaccgccttcggattattcggcatggctctctatgccatccagcagcgtacgaaagaaatcggtatccgtaaggtaaacggggctacggccggggagatcttgtatctattaaatcgtcggtttatcggctgggtagggatcgctttcgcgattgccgttcctatcacgtggtattcgctgagttgttggctggagaatttcgtatatcgggtggacatatccataggaacatgcctgctgtccggcggtatcgtattgatggttacgctactgaccgtaagcaggcatagttataaggcggcatcccgcaatcccgtaaatgccttacaaagcgaatagcgaaaaggaatattttggatactcacctcagtgtcttctcatcaaggaatgcatcacaatcatcatacaaattgaaaaccaattcctcgggaattaccgaccttgatcgccacgtttcgatggaggaataaaaacgttcgaataactcctcctccaatcgctcggtttgctgcatatacccattgccgcttagattgaaaagtaattcccaatggaaataactttccgtattcgtcccccgatgataactgtaaatcttatcccgaagcatgttcgacgcgtcacataacggagcatgtttattttgatcgacagttaacgccttgggcaacttcttatcggcgcctttcaaccaaaccggaaccgcaggagtaaccggtgggtaaccgataaccgtccacatcgtagtgaacgaagcatcctcgtccggccgtacaccttgaatagccacagcgcaagaggtacttctacgagcgataaaatcctgctccgcaaaccaactggaagtctctggcttattatgttttccatctttcaagtcgatacccatcaaaggattatggaacgagcgagataaatgggaccgcacacaattcttcaagttttccgcatcgcgatttttccacataatcggacgtccgtcaggtgttaccttgccagaaatgatagccgacgtgcaagcattggcaaattccatggctcctgataaaacaagagccatgagacacaatatatttcgttgcgtactcatccgacaactacatacatttgttataaaacaacgcattcatgaacaacttactagttccaaagaagtaagaacggaaattcatatcatcagcaaaaacaatcaccttaccgcttctataaggtttcaccattatagcaggctcctctctcaataggttcgcattatccgccgacaagaatcccgacaacaaaggcttcttggtataatataaaggcgaaacatatggatccctatctttctggaaaatgatatcattcgtttttataacagcaatctcatcttgatcaagtccccaagctagcggatgcgtcttatccaaatgacagttcagaattacccctttgatcaactttccggcttttgcttccgccttatccgcaaaagaacgataaaccgataagctgtccgccttttcaagcaatgtttcctttgtctttaaagagataagcccttgtttaccagcccatgcgctagcctttccggtagcgatcaacactcctccggcagcaacccactccttcaaggcagtctcggtacccttagttagatttggaacaccattagccaaaatgataacattgtaagccttcaagtccttgcctgtcaaagacgggttctctatcaataccggacgcatctgaaaacgcttatccaacaagaaccaaatctcacccgattccgggatacttacgccacgtcctaccaacatagccactttcggctgctccaatggtttaaaagccgggctgccaaaatccacatcagccatcaatcccgtgttggccgaatagatatccactcccgtatttttcgccaactcatccaatgtcgcatagagcacatccgaaggaagcggctgattatgcgtcaatacctggtaggtaccatagcccatcgtccattctccctcttcgttcttaaattggaacggacggttggtcgcactgacccgaatccccttacgctgcaactcatagactaccttaggtgcataaaactcccggttctcaaacacataccccacccggctttccccgccgatgagccgtccttgcggaaaatcatttcgctcaatccgatcacccatcaatccggcgacactcttcaccggagcacactccaagttaaacgcatgcgggaacgtccatgtagagatatcatagaaagtactatccgtatattctaaacaatcctccataagcaccttaaccatcgtactgtatttttgcgccaccggaatgacataggctgaacctttttggaactccttgttacctgcggcttgatagtccttcgccaactgatagacctcgatatgatgacgggccatattctccaagaaatgaaaagcgacagacttagatccgcgtgtatcgaacacatagccctgtaccgcctccttccgcgcctcagaagccgtacgttcataatattccttctgataagccagcaaacgggtacgcatcgccttggccgcttccagcgtagcgcaagaggctaatgcctgattccggatcgtccagccaaaggtccattccccgctcggggtattacgcaaatgtccgcgcgtggaaccttgctcatatagcaggcaaacggatccatgcgcatctccataagcagccccttttccgtaatagaagtcatcataaccctccttcgaataataagtcgtcccaatccgatcgagtgcctttgccgtataagaagaaatctcggctgtcaagtcttgattaagctggggagtaaacggatgggtacgcttaggatgtcccggactgaaataataaggacgtaacgccccttgctcatgttgatccacgaccacattgggcaaccattcaaaatatccatttaagccattgatcccctcgggatgttgtgccataagcaagtcgcgattacaatcgatccaataatggttcgtacgactggaaggccaaggctcggtaaactcacgtgattttatatcgctaacattcgtgaaacttctagaggaattcacccacgacgcaaaccgattgattccatccggattggctccgggagtcatcacgacaatctcttggtctagtaattcctcgatctcaggcccttgtgccgccgccaaatgataggcaacagccaacgaagcgttcacacccgatgcctcatttccatgaatgctataaatcaagcttacgatcacaggcatgtcgtctatcactacgcttctcgatttcgccacgtcgctcaactttaagtgctcctccttcagtcgatctatattcttttggttctcggccgaagtaaacacgacctctataaaaggacggtgctgataggtacgccccgtctccctaatcgtgacacggtcgctgcatcgcgccaatgttctcatatattccactacttgatcccatccggcatgttgttctccaagctggaatcccaagattttttccggggtaggaacctgagggtcataaacctgagaaccttccggcaagaaatacgttaaatcatacggatactcatccgcttgtggttgagcaaaaacacctgtcgccaagaagattggcaacaggcacattaaaaaaaatcttctcataactatttatttactttatggattcggttcgcaaagcggattcagttgagtctccttatcaggaatagcccattgccaatccctatgtccggccggacgatatctgttcccgttacccgtcaccgttccatctccatacatattgtaattagaagcttctggatccaccactttaggcattgcgtctttgttccaatattcaatcaaaccattcgggaaaacctcaggacgaggagccggtccacggtccaaatccatattcaaacgtttcaagtcgaaccaacggaaaccttccccccaaagctctatgcgacgttgagtcatcacctcttctatcaagttttcgcccgttttcgtagacaatgtatactccggatcccgatgacttgccagcggataaagagcctgagccgctttgcctggctccccagcacgtgcatatccctccgccatgatcaacatcatctccggcaagcgcatgaaaggaacatcccggccacctttcgtcgtaggatccgatacgataaacttattggccatataattagcatacgctttactgttacactccgcccggatcggtcgcggaagagtattgggatcggtcgccctcggaaaccaaattcctttacgcacatcggtatcactgatcttgtcgtataacttattataaatcgcacgaggggtattgccattatacgaaatgatctcattcgacatatatccatggaagtgagtcaagttcggagcttgctgcaacaaaggattcgatccccacaaccattctgtatttgattgatcgctaaaacgatcattcaatgtcgtataggtatcatcttgcaatttggctcctgatagatcaacgaccaatttagccatttcagccgcttccaaccatttaccttgcgtcaataagatacgagccttcaaaccgcgagccacgtgcaaatcaatatgcgacttattagtccgtttctcctccgtagcacccaataattggatcgccaagtcgatatcctcattgatctgcgtatacacctcctctacagaagctctcgctctcggctccgttgagttatcgttacgaattaccacacccaattgcgtgttatcgccctctgccttataacggccgccatacatctgtaccatcgtgaaataggcgaaagcccggtaaaaatgggcttgccccttgatataattcctctcgctctccaaaccttccgcagcatcgatattatcgataatcatactactgttagagataaaatattgcaacaagcgataaaaatgggtcgcactaccgatcgtcgcattccgatggctcgaccattgagcctgcttttggaactgcgcattgctgtacgtatataccaaatcatcccccatcacctcataccaaatcatcaacatatcgtaaccgccataaaaagccgaactagacagatcacccgtccacatcaatttatgcaagccatttacagccaacatagccgattgggtatcattgaacactgcttgctcatccaccgtttgtgtggaagttgtctccaaaaaatcctccttgcagccattgaataataccacaagagatagcaacactactatatatatatttttcatattgaacatgatttaaaaagtaagattcaaaccaaaagtaaatactctcgcaggcaaataaacatccgcattaccactatatcctgagaatatgtttgaacgagggaaaataccttttcgtttcgtcagcaagaatagattctctcctgacgcatatacccggagtccttgcatggaaaccttctccagccattgcttcggcagatcatagctcaaagtagcggaagccaactccaacatattcgagctgatcaaccaacgagtagaagttcccgcattcatattcgtatctgcgaaatcctcgatgcgaggcacattcgtgacatcgcccggtttctgccaacgattcaagatatccacatgcttgttggaagtcaaggatgcggatcctgaaggctgtgtcatcaaatcagaatatcctacatcatacatcttgccacctagctggaagttaaacaacaggcttaaagaaagattcttccaagatacgttcgtattaagacctcccgataccttcggtgtagattctccggcccaatcataaatggcctcattcacgttagtcgtatatgtttttccatccacctctaccaggtcgacagactccaccgtcagttccggatccggcacatagatagagtttccggtagcaggatctactcccgcccactggcgaagataaaactcatagcgcgaatgtccctcttccacccgatgtactccgctgttataaggttctaccggcaaagaggtaatccgatttttcaaccatgtagcgttaattcccacagaccacgtccaatccttcgtctggatgattcttccgttcaaatcaacttccacacctcgattgtacatcgtacctgcattcttatatgcgctggtagtacccgtatccggtgcttgcgggatcgagaacaataagttgctggaacggcgatcgaaatactctacactacccgacaaacggcttttaaacaactcaaactctaacgccacatcgccattgcgagacacctcccattgcaaatccttattacgaacgacacgttgctggatataaccggcctccaatccgttcatggcctgctcgtaagccgcttgccacgcatagtagctaccgatggcatcattacccacctcaccgtaagcgacacgcaacttcagcaaatcgatgaaatcaagatcttccatgaaacgctcctcgtcaatacgccaaccagctcctaccgagaagaatgtaccccaacgggaatccttgtaaaagcgggaggatccgtcgcggcgcacggatgcagaaaggaaataacggctgttatagtcatagttcgcacgggcaaggaatccctccgtcttgtaggtattcgtataagagtcttgctcgtccggcaccgaataattgctgaactcaaagttgccattatggatggtctggttttgcatggagcctttcaggtaattgtactcataatcataactctcatgtcctaataagacatcgacatggtgattgccgaaattctttgtataggagagcaattggttgaacgtccaagttgtctcaaacgaaacggtcttcgtgcttgaccccacctcagtcttctccggataatagatactggccgaatgccctaaacgagagcttgttcccacggctccgttcaccgtaaacttgaaatcattcaagaaacggatctccgcatacaatttcgcgttcaattgattccgcttgtatccgttgctgatattttgcaactcaatagccgggttattaccagagatatacgcacgcgaaggcgcttccacaccctcctcgatcgtataggcctgaccgaagtcgtacactttattaccattggcatccagcacatattctttggtacgaggatcgtgtacatggatcggatagatcggtccgatatagcgagtgaatcggaaagggttgttgttatttcccgaagcttgcgactgctgcccttccgccttgctgatattcccggagagcgtaccgccaatcttcaagaacgaggtgatctgcgagttaacattcgtattcaaggtatatcggtcaaacttcgatccgatgatataaccaccttccgtcagataaccggcggaaagataataatccgacttattattacctccgctcacgctcacgcctatatccgtacggctgcccgtgcgctggatagcgtcttcccaatcggtatcatccgcccacatgaacgtagcgttcgggttaagcacaccgttcgcatccacgacctgatcgtccggcacgttaaacggattgaagcccagcgttcccgaaatcaagttttgagcggctgccattcccgcttgctctggtgacgcaccaccacttatcaactggttgcgtgcgctctcccaatatactttcaaataatcattcacgcccaatcgttcataatcctgactttgccgattcgtgaatccttggttgattttcacattcaccgacatacgatccttactacccgtcttggtggttatcaggataacaccattaccacctcgtgcgccgtacagagccgcagatgaagcatctttcaagacagacatactctctatatcactgggattgatactactgatactctgatcgtagggcataccgttaagtataatcaaaggggtattcgtcgcagaaatagagcccaatccgcgaatatagatatccgaatctgaaccgggctgaccactggctgaggctacttgcacacccggcgtagatcctagtaaggctgaagttgccgatgtaacaggacgagcctctatcttctctgacttcagcaaactggcagatccagtaaacgtacttttcttagccgtaccataagccacgaccatcacctcatccaatgtttccgaatcatcctccagaagtatcatcatctctgatttgatcggaagcgtttgcgaagtcatgccaacaaaagatacggtaagcgtacgggcatttgccggcaagttgtccaatgagaaacgtccctccacatctgtaattgtaccgattgttgtacctgtcacaacaatattagcaccaatgaccggctcgttatcaactctttgcaaaacacgtcctgcaactttccgggattgttgttcaatgccatttaaataagaagtaggcaaagcctcggcagaaacactacctgccactgaaaaagccaataaaaaatgagctaaaagcacgtttttaaaagtcaaacaacgaatgcatccttttagtccgtgcatattgtcaaaaagattcataataatagttttagattttaatttatcaaacacaataacatccgcaagatcagaataaatattataacatcaaagtaggaagctcattttatttacattctcgtataaataacacataaaaagtagcgaattttcgtgaacgtattccatagaaacaagcctgctattcggcggtatcgtactgatggttacgttactgaccgtaagcaggcatagttataaagcggcacctcgtaatcccgtaaatgccttacaaagcaaatagtgaagaggaatattaaactctattcgcccattggcaatttacttaactgagatattgcctgtaaattggaataatcgtattggtaaaggccatcatcggcgatcatcatcaaggtattcctaaaagggattacatcgtaaccctccatacctgcataatgaacaagctgattagccagcaaggtcataggatctttcgcattgaagacctttaacccttcgtcacagaggaataaagtaccgttatcgatacctaatcctttcggacatttcatgccataagtaaccagcaggttcggttggtccacatcacttacatctatgagcatcagttcattggtattttgcccgcaagtatttccggaatgcacggtcacatacgctaagtcatcctccacgacaaccggatcacaaccaaagacatgacttacggaagaacgatacttaggcgctaacggatcttccagcgaatagatcaacatgccggtcggagttcccatgaacatcttatctttatagttgaaaagagtctcgacatcacgttgcaaccaaatgtcgtttgtcgtcaagacaggcttgtctccagacaggtcgaaaacacacatgatattctgttctaccgtatataagtacttaccataaatagaaaaacgagccatagatccgttcacgccctgcgtggaagtacccggcgccgcatcgttcgccatcagatcaccgccataactcggataatggtaaatggtttcctcccgttccttcggctcccaaccaaccacgacacctttcgctctcgcttcttccgaataacacatattataatcgaacccatagccattctctatggtcggaagcgcataacggaaagcgttctccacacgaccttccaattcaggtctctccggatcggagatatcgaaccagaccagatccacatacgaatccgcatacaatttatcatccttgatcgagagatcctcgttaccgatcaattctacaaagcccactatccggggagatgccggattcctgttatccacgatatggatgcccttatccggggaagaaatatacaggtaatccttatagaaacagatcttaccccgcttggtgattggcaccacctcatccgtcaccttcactgaattccgaaactcggagatcgacatgaataccggttcgttgatagcataccgcacgacctccactcgcactccatcatccttgcatcccattaagacgcaaaggctaaaggcaaacgcccaataaaaaagtttccgcataattataatagatttaatcattaaaaagcatatcgtatacctgcgctcaacccaaatcccaacggcttgtccgtacggatactagccggttgatcacagtcaaaataatgggagaagcgaggctcgaaatagaggctccaatccccataaaaacgataagcagcaccgaccgaggcattcacggaccattgcataccatggatatcctcctttttgctcttggagatagtcgttccgtttccggcgatatagccactatacacggcctgcaagcccttctccatcataaagcctccggagagatagacattccatcgctgattcttccataaataaaccaccagattcaagggaatacccagataatgcaaagacgatttcacctctgacgggcaatcccctcccctcttgaatgtagtggataaatacgtatacatcaatccactttccacggctatacgccggctcaaatccttccgtaccgtaaaaccgaatgatatcggaagggagtagctaacgtccggataagattcgaacgaacgattatccaagaagttctcatccaccttagaactccgtaataccggggcattacggaatgagaccgtttggggaggcgtattaccactctccttttcatcatcgtctttatccggcttatccggatcggggcttcctgccgaattattcatatctcccggagaagaagcatcgccataactcatatccgtatttaaaaagctatctacataaccactagagccaacggcggcggccaataaccacttgttccgtttactcttcttggctttctttttcaaagaggcttttcgtcggggactccgttcgccttccggtagaggaaccgtagagtcacctcgcttaacgactatgtccgtcgaatcctcggacgcatcctccttcacagacggttcttctacgatagccgcaatcgcatccttctcaataatctcgatagtctcacacttctcatcctcccggatcgtttccttttccccgacaatagcggaaagcttagcctttttttcccatttcagcactttcgctatacgtttctttacaggctctacaggtaaaacgggatgctccggaagaatattcatttcctccgctttctccgatatctctttctgaaaggggctcaattcctccaatggcatcttctccggggaaggtagcagccaaataaccaaggccagcactgcggcggcggccaagcctctcgtccacaaccaaccccgtgatctcgctcttcggttcatccgggcctccacctcatcccagccgccagcatctaccggcaaccggtgctcttccaagcgctgccgcatatagccgctgaaatcatccagccgttcgttatgatccttatcgtcccgcattttcatgccttattaaagattgtacactcttttgcaaagcgttcctcgcccggataaactgggaacgggaagtcgcctcctgtacatgcagcatctcggcgatctcgctatgcgtatatccctctatcgcatataagttgaagaccgtacgatatcccggcggcaattgggccacgcaagccaacaagtcatccgccgataaacggtccaatacggaatagttgatatcttccaaactgtcgtcatagccgtccaggcctacacttagcctcgtgttctctgaagaccggagatattcaagagccgtagtgacaaagatccgccgtatccatcccccgaaagccccggagccggaatacgaccggatcttcgtaaatatcttcacgaacccgtcctgcagaagatcacgggccgtctccctgtcacccacgtaacgcatgcaaacactcatcatagcaggagcatattgctcgtacaattccttacgagcccatgattcgcctcgcatacatccatcgattaacagttgttcatccataagtacttatgctctctattatatggatgaaataggtatcctaaaagttgcatcttattcaaaaaaaagttaccttcacatcaaaaataggaggagagtgtatgagacgaggattatttatattcatggcatggatatgtgtcgttggaattcaggcacagtctgacttttcgtttattttaaataaagaaggtaaaatcatcgtcctgcctaaaaacaagacgtatgagttgaacatcccgaaagcctcttataagacatttacccctgcggggacacgggatatcgatattaaactgcgggagttcacgcccgatattccccatacgtccctacaagagcgtccgatggatatgcagatatcttccgccgcctatcagccgttctttaacgtatataccccgatgcttcgggaggtatcgcctatggcgttggatttcaatgagacttatatgaaacggctaaacgaaagtttcgatcttatcgctaacggtgttcaatatacatggccgggagtcggaggcatgacgatcatgaacgggggtatttcttggcacagcggcaattggagtctttatggcggaggattcggtggtcgtttctttagtcccttcaaccctagtcccggaataacagccggcgcaaacgtacaagtggaatatcaacctacggactggttgaaactgaaaggatggggacaatacgcttattacgccgacgagtacaacaatccccatatgcttaggaatccctttttctatcatacccaagtgggcggctcaatggagttcaaggttactgataatttctggatgggagccggtatcaactatgaatacaacccggtacgacggaagatggaaccacagttcctagtctatcccgtcttcaaatcgggccgcttcaagattggaatgtgaggaagacgctatttccgtctcaaacattcctacatggcaactgcctaggataccgacaccaccgtctatattgctaaatacacggatcggttcggccagaccgccatcgatcaaaaggttcgaaactgaatccgtgtctttatcttgcaaaactttcagatatcgatagtattccgccgagatagcatataggtgtacccgtaggtgcttgggtggaatcggaaggaaatcttcctcatttagatcttccatccctatcgaatccgggactacttttagcgggtatgatccataataaggttcataataatactcatccgttaagtgcaaggtatattcttgcccgtttattaactcatcagaaaagacctttccatcatacccatacatccagtcattgccaaagatttgatccaaggccgtcaacgattggccaaaaacaggttcagtcgcatagtttggactcaccgagaaccatttatattctcctgtatattccttagctattccatcaaaaacaggaatgccctcttccatacgaagtaaataataattctcctcggcagggttatctttgagcgttacctgataaatcgcattctggtgagaaccgaaagaaccagctaccgtggcataggttacccccgctttcaagacccgggcgggcgctggcatgactgtctcggcgcttgccacaccatattccggataagaagcttccacacggatacgatcccctttcaccggtataaaatcagacttaaaataccctttcgtgttaaatgcctcatccccctcctgaaagctcatacgctctttaaaagcgccattcacgaataaattcacctcggctttatccaaagtcacgttcggatgatcatccgtgaaaaaccaagtacgggagacacttacggttaagggttcgccggttatagcgacacagttcaccaccaaagtgggatccggccgtaaggattcaagatcgatctccttgatgcaagacatcaaaccaaacaggcttactatacaaatcgtatttattaagatactctttatctgtttcatcttcctagaatttataagtatatgatatggaaggtatgataggcataatacctatcaacttaaaacaaggttttgttttaccgttatagggagaagaagaacccgggactaagttattcgttcgttcccagttatcacttttatagaccataaacggattcatccggctatatacattataaatactgatattccagatgcccattcgccccttctccttcggacggtaaatattaagtcccaaatccagacgatgataagccggcatctggtaattattacgacgtgtatacaaatccaccacttccccggatggttcccaccagttattcatcttgtattggttggaaatagtaagcgtaccagcttgctcataactctccaacgacaaggtcatgcgattgccggaagtatacgtccaagcagctgtcagctccaccttttccgatagtttatgcgataccacgatattcagcttatgccggttatcgtaacgtgccggaaagcgtcgcccgttatcgatctcatcgaaacgccgatccgaccatgaaagcgtatatcctatccaaccggtcgtacgtccgctttccttgcgagccaagaactccacgccatacgaacgccccttaccgaccgccattttttcctcccaagccgccgtaccgggcaagaaggaatagccgtctttataatccaacaggttcttcatccatttataatacccctctaccgagaaactataagaacgcatcagattataatagaaaccagcggagacttgatcactgattaaaggtttcaacttacgggtaacaggcatccacgcatccgtcggcaaatttatataactgttgcccaataaatggatatattgccccatacgggcgtatgaggctttgaagctaagatcgtcacgtagcaaccatctcaaggaagcgcgaggctccaataaggtataagccttccgctccacattgaacaggctaaaccgaatccccgcattcaaacgcaagctaggtaagacattccaatcatcctctccaaagatagccgcctcacgggcccatagcagatcatttgtatatattttccctatattcgaaaactccagcataccggaaccggctgctttcacctcattatactccgggcggaaacggtgcatcaagaaatcccctccaaaacgaatcacatgcgacgtagaaggcgtgtaatcaaaagaggaacggacgcccatatccaagatagaggtagaactactcgtttccgatgaagaagagagataattatcttctccttccacaccataattatattcttttgaactccgtacattcgagcgataccgtgaaaagaccccggaaacccgtccgaacaaacggttattgaagacataagtccagcccaaggttcccatcaaattaccccaacgcagcgatgaatgggtaccatccgtataagggacttgctcttcttctgttgagaaatccgttccccctccttttaatacatcattcccgttatataagctgaaaaacatccggctgcgatcgctgaaacgatgattaagctttaaattcaaatcgtgaaaagcataacgaagatttattttatgaccgtcttttcgaaccttatttgctatcgctatcgctggggcagagagtacatccagccacgagcgtctaagcgctatctgaaaagccgtgcgatccttgatgatagggccttccaagctcagattaccggagatcagcccgatcgtagcgctaccatggtactctttcatattgccctctttggtatggacatctaccacagacgagagtcgcccgccatatctcgcagggaaacccgccttgaaaaagtccagattacggatcgcctccggattgaaagcggagaatagcccgccgacatgattgatctggtaaaccggattaccgtctatcaaaaacagatttccatcttggtcgccgccacgaacatataaaccggccagtccctctgtcccactggctacacccggagtcagttgcaaggtcttcacgatatcggactcaccaaacagggtcggtgtcgccttgatcgtcttctggctaaactccatcgttcccatcaaggtgttatttacagacaaacgatcccgctccgaggccgtaactaccacttcctccagacgggcgttcggacgcaactcaatatttaatatggtatccctatccaattccgtgaaattaaaggaacagctctcataaccaatgtaagaagcatgcaagcggatattccccggcggaagcgtcaaactgaaaaaaccatagctattcgtagccgagcctttccggctggcgacctcataaacagaggctccgatcagagactccgaggacgcttggtccctcacgaagccgctgatcgttacctgtctctgtctacgcttcagaatcacgatctttccactcaccttatacacgatcggatacgactcgaacaagcgggtcaaacaatccgtcaatgtctcatctttcacttggaaactgatcttcggaagctctttcaacaaagaagactcatacgagaaggtcacgcccgcctgtctttcgatctctgacaagacctccggcaacgaaacctccttcatacgcaacgtaatccggggatcatccttcgtcttggctgattgggccaagaggtctggaacaggcataaaaatcatccagcaaaaaatggccataagccatttattcatccactctgtcatcattctacttcattgaattcatttataagacaagatttcctaaaatacccctatccgagaagggtctttttcggcgtagcccactgcctactgtacactgtatccgtcccaaggattccaagaaggaggtaccgtatctctccgcatcgtgatacgcaatttatcctcttgatatccggcgacaatcccaaagccgttctccacattcgaatacgtatcggcaggctctatcaacgccccgaaattcgcgtcgccgatcgtgatagagtagccccgcataatcttcatatatcgataataatcctcggagatagacaacagatgcacatcgtaatggactttcgacgaaagcgtgtcgctctcatacgaataatctaccggagaaacagacacacggagcgtattcccggaaatcatgtccttccccgcaaacacccccatacaataccgcccgtctatctgactcgtgatcgggcttccctcgaaagtctggaataccggatcctcgtaatataggttaaaataagtataataccaaaggtatccattcgcactttggtaagaggtcacagtcatggtactatcccctttccggtaatccgtcactttctctatgactaaacggtaatagccactactagcgggattcatctcgactgtaaaacgtaaattactggatgaatatgaagaagatcgataggtagaagtgtccacaccgataatcttcactccaccgggaattagagtttcccccgagactggttcatacccgtccgcctccgcctccatgcgtaaacggtctccctcacgcacccggcaaccgggcaaaacatattgccccgtattaaaaacctcctccttaaagtcatcataccgcatcaaaccttgaaactcgccattgatgtagacacgaattttcggatccggtaaatcgaaattggccacattatccatgataaaccaagtcttcgagacatgggcacgtacatccttcccgggactcaccgaggcgttgaggacgatccggtccggcaaatcccctaagtttatttccacgtcacgtacacatgaggccgctagcaccccatacatcaagatacatatagccagtaaacttcttcccataagctaaaatttataagtgtaagagaccgatggcatacaataaaacaaaatcgtctcctgcaaaacgacgtcggaaccaccagctttcaactcggtcatgaaagggttcggcttcagataagcgttatataagcttaggttccaaatccccattcgtcctttctttttataccggtaaaaattcacccctagatccaaacgatggtacggagacagttgataattattgcgtgcgctcaagccgggattcgtatccatcatccctaccacctcaaaatatccatgctctctctggtaagagggagaaagatacttatattccggcaaactgatatgattgcccgacgcgaatacccaagccgccgtcaactccaccttccgggataacttacgagaaacgaccacattcaccttatgccggttgtcgaagcgaaacgggaaatgacgccccttattcacggaaccatccggaaaccaccgatccgaccaagagagcgtatacccgatccatccggttgtcttcccatttgtcttttgcgccataaactccacaccataggtcttaccctttcccaaaccgacccggtcttcccaaccggagaaatgtgtctcaaccggccaatgatccttataatcaatcaagttattcaaccgtttataatacccctcgatcgagaaatcatacatccgtttcagattataataaagcccggcagtaatctggtgagaactcatcggagggacttgctccgtcaccgggacccaaatatccgtaggttggttcacataggtattcgataataagtggacatattggttcatcttactgtaggatatcttcgccgatagatccggacgaagtaaataacgtgccgacaaacgaggctgaaaagaatgatagatctcattctctacatgaaacaaggtataccgcaatccggcattcacccgcaagcgatccgtgacccgcatctcatcctcggcaaacaaagagaactcatgcccttttatcaaggaataatcatacaaaagctcatatacgggatttactaacgaatcgttcacccaagaccgttgctggctattctccgggcgaaaattatgatacaggtaatccgtgcccattcgtatccggtgattcattgaaggactgtaatccaccgacaaacgtacgctcagatcctccatctccgatttatagtagctctctcgtttgaacgattcttttccctccttacctgcataaatttcatatccccccacttcctgccggatatgagaacgaaaacggctgtaacccaccatcaaattaccaaacagtttttgcccgaacacgtagttccatccagcagagccgatcaagtttccccaacgccacagaaacatatcctcggaatccccattcttctccttactcccttgcctgaaagcatcttgccccatataaaagctcagataggcacggctccgatccgagaaagagtggttgagtttcgcattaatatcgaagaaatgataaccgaaaacatctttgatactactgttcttattgactacagccaaagccgtccctgttatcaaatccaaccacgtacgacgtaccgagacattaaacgaggagcgatccttaacaatcggcccctccagattggcccgtgcggaaagcaaacccacggagatattcccgtgatactcctgccgattaccgtcattcatacggacatctacaaccgacgagagccttccgccgtattccgccggaaagctccctttataaaaccgggtattctttatcgcatccgggttgaacgccgagaaaaaccccaacaaatggttcacatgatagaccggatttccatccagcagatacaaattctcatcggccccgcccccacgcacatacaagccggtcattccctcggtgcctaccgccacgcccggcaactgctgtaaggtcttcaccagatccgcctcccccagcaaagcgggcatcgacttcacccgctcggcaggtacgtcgatcacccccgcacggctactcaatatctcgtagcgaggccgggtcccccgaataacgacctcgcctaacgaggccaatgacctcaacgggaagtcgatcatcgtatccctttgcaaatcgatctctatctccatcgccttaaagcccacatacgaggccctaaggcgaaccttaccgggtggaagtatcaagctgtaaaagccgtaattattagacatcgtccctcccctcgaacttttcaccagaaccgaggcccccaacaaactctcatacgaggctgaatccctgacaaatccgctgatcgtatattgacggggctttcgctttaagatgatatattgccccgtaacccgatagataatcggtaatggggaaaataagcgcttcaagcagtacgacaaggattcatcccggacagacagggaaacctctggcagctctttcagcagagaagactcgtacgagaagaacaatccggtttgtttctcaagctccatcaatatatccaacaggggaacctgccgcatatccaacgtaaccgtcggcgtaggttcgggcatctgcgcatatagatgtcccatccaaccgggaagcaaaagaatccctatcagccatacaacaatagatctcataaaatgatctgattttatttcttcgaagtggaaaccaaacgtgcgtccaatgtctggttaacaacctgcaatacatcctccaagggcagattattaaaagtagcggtcaatctcgctccctcattctttgtccggttcgcgatcttgacttgataataatcactcaagtcctcaatcaccttatccagcggcgtctccataaaacgcagttgccccgttctccaagccaacttgttcacgtcttcttccgtcactaccgttatctccttgttctccacagaatactgagccgacattccagcggtaagtatcacattctccttttcctccccggcggtaaaacataccttgccggtaactacattgacttccgtaacggtaggcttctcatctatctggaaacttgttcccaacaccgtaacttccgtttggctcgttttcactgagaaagggcgtgcctcattcctcgtcacttggaaaaaggcctttccattcatctccacggcacgcctctctttatcatatctcttcgcgtcataccggatccatgaatcgccagccaaagcgaccaaggtactatccggaagataaacatctttcatttgtccgggggcggtagtaatcgcaacccaatccggggcgtttctctctaccgtaaaccatgttcccagacctacgagcactaacacgacagcgaccgccccgatccaataccggcgaaacgagaccttccggctaatcgcatgctcagaagcgaacttctgccatgccttatccgggtcaaggcttccttcccgatagcgtttcgctacgaaacggatgcgttgttccaatttattgtcatgctcgttattattcataactattccttctatttaataagtccttccagtctcataccattggaatccgacatttggggcctgccccttcttcaatggaactcccacgctcatactcggcgagatcctagacgatacgcaagatgagaaaatcatcatcgacaccgcgaatataaatacccactttatacaaaccatcgctttcatcctattttctctttaaaatgtgtatcccaaggtaaaactagccgtatgatagttcagacctatgttataagcatatcccttgtattgcttatctatacccagatcatagccaaccttgaaagcgacccgtttcacctctataccagcctctatggtagctccccagtcaaaacgaggcgctaccgcatatccttggccgggattaaacgggttatatgatatttccttattatagggcagctttccttttaaagaataatcactttcctcatacgtcacttttcctcccaagccaaccgccaaatagggaccgaccgccaaatgtaaccgaacatccttacttacctgccaatcgaaacgagccaagatcggtaattggatatattcacgatgctccttctgactgcgatgccttataccttctacatcaaaatccttaattccataggtatcataatagaagcccgtaaagccgtaaccattaccataaccgtatccccacagattcaaataatcactggaaacgggatagagaaatatactcgtaccttcccgtcccccatatggactctcactagttccataaatctcactataagaagacagccccttcccccgtcgcacatagtacaaaccggattgaagcgagaaccagcccgatccgaatgtataagagaccgcggccccagccttaaagcctaccttagcgacatctcccttatactttgtcacgttcataccggcttccggcgtcactttccattgcgcttgggccgagatcacgcacgtcatcaacatcacaaataccaccaacttcctcatacactctccatgctttaatgaaataaacaagtaacctttatctctaagacagagaaatatgaaaaacccccattcctttctataaaaattatccgaaaaagaacatataaacacggatagcggtctctcgcaaagctttcaatgccttgctcatctggttctcaaccgtttttaccgataaattcaattcctccgcgatctcttggtatttcaagccatcccgtttggataacaagaaaatcttcttccgttcgggaggtaactgatcgatagcgtcccacaggcgggcgtcacgctccgatcgcaggatgtcttcctcttccgaggtatcttctacgtcgggtaactgctcggtggcctcagcgtttacgggttgtgaggtaaatgaaagagaacgattcctcaccgcttgatataaataagccttgagattcccgatcacattaccagcccggttcttatcccatacatccgcgaaggcctgttgcacgatatcctcggcatcatccacctgatcggtataacgaagcgcaaacaaacacaagggcttatataaactcttgaaatgatgttcaaattcttgggtggtaatagcagccatacgtttgttatctgtaactattcaccacaaagtaacaaccttttctttttaacaaatcgcttttcaggttctttataatggttttaataaaaagaaagcgtttaaggacttatccctaaacgctttttcttatttttaattaataagcatcaatatggacgaaaaccgataatctggcgtacctcatttaaagtcttagaagcgctctcacgagctttctccgcacccatacgggctaccttatccagatattccgtattggcggccatatccaagatacgctcacggatcggagcgcagaacttattgatatcctcggccaactgctttttcatatcgccgtaacggatctcgcaattgttgtatttctcattaaagaaatcataggtctctttctcggagacaatttccatcatcgtgaataaattggcgatcggctcgggcttcacgctattcggctcggttggtcccgcatcagaaaccgctttcataaccttcttcttgattgttttctcatcatcgatcaagtagatcgcgttaccctcactcttacccatcttaccggagccatccaagcccggtactttcacggacttattgcccaaatggaacgacgcaggttccgggaagaaatctactccataggtagaattgaaacggcgggcgaaacgacgagccatttccatattctgctcttgatccttacctacaggaaccttcaacgccttatggataataatatcggcggccatcaaggtcgggtaagtcaacaaaccagcgcttacgctatgtttattaccttcattaaaaatctctttctctacatcgccttcacatccttcccggctgatatgcaactgctgacgggccttatccttaaaggaagccgtacgcatcaactcgccgataccggcgttcatattcaaatatagatacaactctaccacctccggcacatcgctctgaatataaatggtagctttttccggatcgataccacaagccagatattccgagaggatcgtctttacgctatttcgtatattgtcaggatgcgggtgagtagtcaacgaatgccaatcagcgataaagaagaagcaattatactcatcttgcatccgcaagaaactctttaccgcgccaaagtaattgcctagatgcagattacctgttggtctgattccacttactactgtttccatgtcttgttatttttagttttcaagtggcggcaaagatagtaatattctcacaatatacatatattatatgccgcagatcctcctaaccacctattataacggtgggacatcccaatacgatttgccctccgtgagctgtcgtatctcccattctggcggcaggtttaccgcagatcatcacggtggaagatcctttaatgatcgtatccggaggacctacgcaaacgcaactatcccccattaccgccgccggtagcttgccgattagaacagtcgccgctcccggccctacgataggaccgcctacatggggtatcggtgatggccaagccggggtttgcataggacatgtatgcatatctgtcaatcttgctgctggaggcatatttattactttttagttaacgatttattgaaatgataatctacaaatatataatatttatcatgaatatactacttttgcgcgctaatatttttaatcatgaatgcaaaagcaaaaggatatgttctaggggctatcgccgccgcgacttatggaatgaaccccttgttcgccctacccttgtataaagccggtatgaatccggattcagtcctgtttttcagatatttattcgcgatcccggtattgggtatcatgatcaaagcgagagggcggaactttaagttgaaacccaacgagatcgttcctttaatcctcatggggctgttggtttccttctcttccctagcgttattccaaagctataattatatggaagcaggcatcgcctcgactttgctgtttgtctatccgatcttagtggcgctgatcatggcgtttgtcttcaaggagaaattaacgttacaaactatcttttgtatcttgctggcattaggcggtatcggcttactttataaaagtggcgacggaacgactcttagtttaaccggtgtcctgttggtcatggcttccgctctttcctatgctatttatatcgtaggcgcgaatcgtccgctattgaagaatatcgctacgttgaaacttacgttctatgtcttgcttttcggaatgaccttgtttttagtccgtatagatttcggcaggagccttcacattgtccatgattggtatttatggggtaacctgatcgctctagccatattcccaaccgctatctctttcctttgcacgacactggcggtccaatatatcggctccaccccgacggctatcctcggagctttggaaccgttgaccgccgtattcttcggagtgactgtcttcggtgaatcattaacgttacgattgtgttgcggaatcatcctgatcatcctagccgttaccctcattatcgcaggaagtaacgtaacaagccacctagttcgttttcgaaagcttttcccaaggcttccgcttaagaaaaagaacgctaaatcataaaatcatatacaggcatcatttctagatactattctacggggctatcgcaaatctatgataaattcgtaaaatcatttgttacaatcaattattttacatatgtttgcgagaaacaatacgtatccaatcatgatcaccaagttctcaacatgcttattgttccttgcattgctcttgaatagttgccaacaaaggaatcaacccacctctccccaatatgaagcggagtataatcgttcgacaactccggccctcattgatatagaaaaggcgctggaccatccagcgatgttgaaactgagtcaaatagcctctaagctggaatattataatgttggagacgctcgttacacggtaacacaagcgatcgctattccggatagcgacgcttttatcacattcaataacccacgtatttattatcgtaagcaaggcattcccagcaaacgatatggatttaaggccttggattataaatggaaccatgggatgaacggccttaatctattttacgacaagaaaacaacccgtatgtactgcgccttgagcggcctcgaccaagacaataaaaaagattcgaccacattcaacgatataaggccatgtatcggggaattacccacattagatacgatgctgaccattcagaattatatattccccgaaaacctgcctaccaaatattcgataaatgcggatgccagtcaaatagtaggcttctcctcctcgggatatatgctttgtgattacgcggaaggctctaaaatcccgaaaggaataacgacattcaaccttcgaggagatacgctttgcaaattcatccttgcggatgccaaagatattaacgtctctccggatacgatcacccggtttcaaaccttttattggaatacggatcaagaccgaataaatttcttgattccttatcgagatacggtataccagctttcaagttcccactcgatcacccctttatatgcgcttcataaagacaatcaagataaaccgaccggtcttcgttctttcttggagaatccgaatgggctatttatgggagtctttcaaaaaggttctcccgccatctataattggctgggatggctggacgattacaaaccggttatcacccatcgagtagtctatctcaagaaagagaagaaaacatacgccttacccaaaagctccggaggatttatcaatgatatagatgatggacttccgttctggccagacggacaaaccgatgactgtgtttatatgattcgtaccgtcaccgaaatgcgtgagaccgttaaacgcacaggctcctcccgccaaaaagacctgatcaaattcttagacgatcctaaagtgttcgagagggattatgtaatgatcgtggcaagaccttgatggatattcaatagataaagccaaacatccataaaggaatcatattgcggaaagcatactctatgtcatctttcaccacatacccatccgccgcttgcttgatctgttgccgcatcttattctttcccccaatctcaaaggttcggccatctatctcaaagtctgaaatcgcagaagaagtaacgaagcatacgactcgcatccaagatagaaaaaccgtctcacgcacggaaccgatatccggtacctgctccgacaacgcataagccagattcgtattattcagatagatcttctctactttctccaataatttcaagccctgcgctttttctcgcagtaaattaaccagacctgccttctccaaataactcatgtagtcgggcaacacattccggctgatatccaaatctctcgccaacttcgtataatttggtttgaaagggacactttgagctaatacatataataatttcttcaactttacggcagaagccaccgtcatatccgcaaaaatcggaatatcagattccaccatttggttaatcacgctacgcagacgcaagagatattccgtatcttgaaaaaatggataataacctgtcgataaataatcattaaataatttgagtggacgagcttccttataagggaactcaaccttcccagcaagaatctcttccaacgaatacgatggaagctgccacccctgcgatatattcaaatattcccgaaaagaaagtccgggtaatctatactctaccttcctgcgacttaaatccgcaccacctttctccagatcaagaatagacgaacctgtatagataacttgaagaccaggaatttgatcgtatatattcttcacctccctagaccaatctttgtatttatgaatctcgtcaatataaagttttttcccacccagattataaaattgataagccatgtcgaataaccgatacttggtaaaatagaaatcatctgccgtaacatacaaagactcatcctcacgatcatacaatttgatatgctgcaacaatagggtagtcttcccaacaccacgagcacctaaaatcgcaaccaatcggctatcccatgcgatctgatcgtgaagaaagcgcacgacttctgtcgaagtatgctctaattgagttctaaaggaacgaaataaggtctccatatcgattcatgtttaaaggacaaatatacaaaattgcacatcgtatcgtgcaattttcatacaaaattgcacatcgtatcgtgcaatttcctttatataggttgaccatgttctatcctattgatgaacgaggtttacccggacaaaaataattaacattgtttgcacaaattcattcaactcacgatataaataggtgaccttagattggcaatcctaagagcaatactgacttggctaagtaatatatactgacttgcccgacacagtatatattacttagccaagtcagtactactgccgatagcaagctcatcacacaaataaaccatcaaatgaacgttgaaatggagaatttactctcccgaaacgatctttagtgaatatcctttaccccgagcactctctatcaccaaacccggaataggagacaaatcctctttaagccttttagccgtaacggtaagatgcacgaaaagtactatctaatgataatatctgaagtgccccccctgtataagaaaaacaaaaatcatccccaagttctttgatacgccgatctgtatcctcttggactacctgttgaaatgatagcaatacaaatacataactttatgccaacaaaccctcattttttgtctgtcagctaaaagtcagctaaaacaattggccatgaaaaggaataaacttatgtttgtgaaaaattaaatacgatatgaaacgagcaatctattaaaacaccgtccttcgcaaaaagaacaaataaaacgaatgaaactcttttggatcacgctacttatatctagtttagtctcttgtcacaatttcaaagaagacagacaactctcattcgctcttgaaagagcaggcgaaaaccgccgtgaattagaacaggtattggaacattacaaaaatgattccttgaaatatcgtgcagcttgctttcttattaagaatatgcccgggcattattcttattgcgggaaaatcaccaacacatataataaacaaattgactctataatacttcaaacacaaaaagaggggcgttatcatgatacaccttatcttgccaatcgcattgatagaatctctaaaatccacgagaacacctcattcccgatacaagaagacattcgtataattacagctgattttcttattcaaaatatcgagcaggctttccacctatgggaagatgccccttggagccgacatttaaattttgatgacttctgtgaatacctattgccctactctatcggagccatggatgtactggaggattggaggactggcatgtaccaacaaatagattctacgacattaacagaactcaacgacttcagctattcttccgatatgcaaaactcagcattttgggcttgtaagcatatcaatcagtttttagagaagaaattagttcctgaaaactcggtatattccattccgttcatagcaaaaacctccactaggagcatgatatcattcggcacttgtaatcaattctcgttaatagcgttagctatgatgagaagcataggaattcccgtcatgctagatttcacaccacaatggcctttccgctcgatggggcattattggaatgtacttttagataatacaggaaagaatctagcgtttggaggatgcgagacaaaaacagatccggatatactgcataaacctagccagaagatggctaaagtgtataggcgaacatacgctattaatcaagatctcgtaaagctgaatacaaccgaagaggtcgtgcccgacctcttccggaatattttcatgaaagatgttacctccgaatacatgaaaacttgtgatatcatgattccaacacaaaaaaaacgaaaccataaacatgcctacctagccgttttcgacaatcagaaatgggtacctatatgttacggtacacaaaaaggaaaagtttgttacttcaatgaaataggaaaagatattgcctatctcccactttattatgacaatcaaggtattcatcctattacagatccattcatacttgattcacgaggtagaataaaatatctacatgcagataccagtaaacgaaagaaagttatattatctaggaaatactatctcgcaaaacatattttcgattatgcaaaaactctcaccggaggacattttgaagcttccaataatccggatttctccgatcctgatacaatacatacgatttctcattggttattgtccgcagattctttcgagataaaacctcaaaaaacatatcgctattggcgctatgtatcagcaaaaaacaagggttgtaatctagccgaactcgctttctactcagacaaggaggaaaaagaattaaccggcacaatcattggaacaaatgcctcggttcgttacgatactatgccaatggataaatccaaagtatttgacaaagatatcctaacttactatgaagccccttctacggttgattatccatgggtaggcttggacttcaacaaaccggtatctatcaataagatcatttatacgccaagaaacgatgataataacatccacgcaggtgatctatatgagctattctattgggaatataaccattggatgtcattaggccaacaaagagctattgaatcaaagctaacctatacaaatgtaccagacaatgctctcttgttgttaaaagacttaaccaaaggagaagaagaacgcatattcacatatgaaaatgacaaacaagtttggtggtaatctttattattccatgagaaccatattaaattaattacaacaagtaggcaattttaattttatctataaataactgataatcagcgtgtaaaaaacatcattatattttccgaaaaactcgtacgtgtttttactaaaagtcgtacgtgtttctaaaaattcacgtacgtgttttttagaagacgaagtcgagaagaatataaacattcaaaaaaatacactaacccaccttgtaaaacctacccaccacacttcagcacatagccatgcccccgagcactctcaatcaccagatccggaataggagacaaatcctctttaagccttttagccgtagcggtaagagcgtctttggacacacttccatccggccagatttcttctttcagccgattagactcaatgaaatatcctttatgttctaataaaatacaaaacagtttcagccgttgatttgccaattcgatacgatgcctatgataatgcaatacgccatgtgtttcatcgaacaagatatcttctgttatttgtatcatctctttaggtgcttcttgtagcggtaagatatttatccttggtcttttccatgtcaagacaatcgcaataacccagagaataaccattgccagaatccaaaatatatttcgcaaaaacacttcacctactatataaaggaaaggaaattgaacaaacgcttgtaaaacgatcgtccgattcgctccaaaaacaatatcttttaatggtatgaaagattgataaaaagaagtatctgaagagctacattccgtcttgtctataaaggtataacaagttacggtctgagccgaaatcgcatgttcatacaaagatgcacgaaaagcgctatccagcaaggttacttgaatcggattctccatagacaaacaatgttggagacaaaaatcagacttctcctgtgaagacatcctccgtgccacctccttattattcctcatatgtataatcgcatcggcagtcttgattgtaatgctatctcgttccaatcgattagcgcctgaataggaaaaacaaaaagcatcccctaaatcttttatccgcctatttgtatcatcttgaactgcccgctgaaataacgtttgagactcttcttgtaattcatactttacattttggtatgatttataaaaagacaacaagcaaatcatcgtcatcagaacaaatacactccacttccaataaaatttccaattttgcttctccataattattcctcgttgaaactgcaaagatacgttttccatccctttctacgaataaattcattcaactcgcaagatgaaagatgactataggtagacaaaaggcttatttttcaactgtcagctaaaagtcacctaaaaagattggctatccaaagaccaagccgtacgtttgtaacaaaaattagaaacgacatgaaacaaattactttcaagaaagctttcgctatcattttcatttgcgccttgtgtgcttcgtattttcttttgaaagaaggaaaacaaaatttctcagatcttactttctctaatattgaagcgctagcttccggtgaaagtggatccaaagattgttatatggctggctctctatcatgtaatggaggatattacaaatatatatacaaccgttaaaacaacacatgaactactacgtgtacatagttctattaataggtagtctggtatcctgttcggaatcctcacggcacttcccccgctacgaggattttcccgatgaaaaggcattaaatgcgcaggttatccacctaaataccgccttgttccgctatcctttccgggtaacggtcaaggatggtatcgctattatcatggacttgcacaacgtagattatttcttccatgccttctcttaccccgaatgggaatatatgacatcgtttggcaaacgaggcgagggacccgaagaaatggtatcggcagattgcttccggtttatctccaaggattctatctggacgctcgatgcgaacaaaatgcgaacaacccggtggaagattgaacaaaatatgaacaacatcatccccgtagaaacgatcgatatggacaagcggctggttagggcattggacttttacccgatggaatcgggctttttggtatctgactacctcggtgaatatagacaaaagtggacagaccgagaagggaaatggattcactccgctaatcagatcccgactgaaaataattatgaagacatcgcacgccctgcattggcgcaagcgtggcgaagcttcttcgactataatccccaaaaaggcatcttggtcatggcaacccaactaggagaggcattagaaatatacaacttcacagatactacacaaaccgtacggtatgggcctaatggagaacctcaattcgcaatctcacgatcggagggaattccaaccggcatcatgggatttagtgatgtccatatcacagaccatttcatttatgccgtattccatgggcgtagcttcaaagatatcgaacaagcatacctacgaggggaagagattgaggatggaggacgatatatctatgtattcgacctcaaaggaaaccccgtccggaaatatgtgctcgaccatgccatttacggtatcaacgtagatgaggatacgggaacgatcctcgccacggatgtaaacagcaacgatccgattctttcatttaaaatataacgacaaaatatcatgaaatacttaaatctaatcatactattattattccttctagcttgccaagacaagaaaaaagacgagatcaagcatttagtatccgaatggcaaggaaaagagatacgatttccgaaagacatggtctttacacggtttgcaaccgatacggtagacttcaccctgccaaaatccccccacaaggtgctggttttcgtgaattccataggatgtaccagttgcaaactccaactgcaccgatggaaagaactgattcaatacaccgactccattacccaaggaacggttccattcctgtttttcttccagtccgatgataagaaagaaatacggtatctattgaaaaaagacaatttcgacaaacctatctgtctggatcaatccgacaagctgaacgaactaaatcatttcccggccgatgggagatttcaaaccttcctattggataagtacaataaggtcgtagtgataggaaatcctatccacaacccgaatatccgggtgctatacctaaaagagatcaccggaaaacaacccgcttcacaaatacagaccaccgtgaaagtggaagaggcatccatacagctaggaactatccaaatgggagaaagcaaagaagctgttttccgattaacaaacacaggaaataacccgttagtcatactagacgcggctacaacctgcggctgtgcccgcccatctttcgacaaacatcccgccaagtcgggtgagacccttcaagtaagagccatcatgacaccgaaagacaaaggagtctttgacgagacgattaccgtgaaatgcaatacgaatcaactgataaaattaaacattcgggggatggctcaataaataaaagagaagggagagcttgccggatatattggaacgatcacaagcaagcctcccaccccacttttactcatgaagcagaaaggaggtgacacaaaagtagtaaattaaattgaaagaggaattcgagaatatccttatcttgcagaagaatagtaagcaagagattaaattctcaaaaacataaactataaaaaagaaatatcatgagaaaaaagattttaggaatagccgtaatggcagtcgtagcagtagctgcggcatggaacatcaaccagagtgaaaacgagattaaactctctgatttagcgcttgacaatgtggaggcattggctagtggggaaggtggaagcggatattgcagttactctgggggaggatgtattatcaaatattccgatgggacatccacttacataccgggacgttggaactaaaatttaatcaaaggagggtgtgccaaaacgaaaaaaatcacaatggaatacagtcggtaaatcaatggaatgcagatgttttctcattgatttttaatttgtatttcatagactctaggtatcttgagcaagaagaaaatgtgttcaatcccttaatttggcatgccctccttaaaaaatcagtatcatgaagaaatacattatcttacatctttcactcatcctattagtattcatcgcttgtaccgatgatcaaaaacaagatgacaaaaacataaccttccagagaagtgatttcaaagtccgaaaatcactatccggaaaaactattgaatttgacagtcttattttacgaccttcacaaatccaattattcgactccttcctagttacttgcaatcaaggggcggaaaaacaattccacatcttcaacctcaatacggcacataaggaaggagaatgtattcctgtaggacaagggcctaaagagatgatgacaccatgtttcgtcaatcggaacgattccgtagtcatttttgatatgatgacctctacgattttcacttactctatcccggaatttaccagtggaaaagaaccggaatacgccagccgtatctccctagatacaaaaccgctatggagcaatattcgaagcttgggcaacgggttcttaggcgtatcctatcaagagacgagtcctggattcctttttgatcaaacaggtaagaaaacgatggatttcggtacttatcctaaaactgagcaggagtatactcctgccgaattaatcaatgcgtttcgggcagacctaaccaccaaccgaaaagagaaggttgcaatcactcactacttcactgatttaatttgcatctataacgtgaacgggaccttggaaaaacaattacggggaccggatcatttcgcatctgttttcaaagaatttagggatggagacattatcggaagtaaagcgagcccgcaaacttatagagacgctttttatagtcctgtaaacgtggggaatagtttatttgttctttataatggaaaaatggtgacagagcctaattacaatatattatgcaaagaattatttgtaatcggatgggacggtagccttgaatgccattacacattagaccaaggagtctcctccatcgctgtagacaatcaaaaacggaagatctatggtatcagtgatgatccggaatatcatatcgtagtgttcgactattgatgactgatatccaaagaatttggatttaggaaatgaggcataaacataaaagaatgggaatagaaaaacgtatatacaaaacaaatataaatcagatgttacgatatctgacacttatattttatggggtatttggtattggttgcatatacgcattcctcctcatcttctgtttcagcacgttcaaaatcccttccgattccatggagcctcaactccaaaccggagatcaagtattagtaaacaaatggatagccggacctaggttattcaatattttcgcatctatgaaagggaagcgggtagatatatacagagtacccggagtcgggcaaatcaaacggaatgatattctcgtattcaactacccgcatccctattcatgggagcggatcgaaatgcacatcatgcaatattatatcaaacgctgcctcgggttaccgggagactccatccggatcgaacagggattctaccgaaacaaccatacaaaagagcctttggggaatgtggaaagtcaagcgaacttatccagacaaaaagcggatcggatgccggacggtgtctaccgttgtttcccttttgattctacattcaattggaatgttcatgatttcggtcctttgtatatcccccgaaaaggggatagaattaccgtgaatcaaacaaattataagctatacaaacaaatgatcgagtgggaatcaaaagattccctatcgtggaaagatagtaaagtttatataggagacaaacaggtaagacaataccagttccaaagcaactattacttcgtggccggagataagacagaaaactctagagattcccgttatctcggacttataccggaggaatttatcgtaggggtagcttggaaagtgtggaaatccgttgacccttacacgggggaatacagaaagggacgtttttggaaaaatattcgaaacaattgaagaattatgaataagcttattttatatgtatgcgcttggatctgtctgcactcttgcggtttctcaaaaagccaagaagaaagtatgttggaatatgcgttgtcgcaagccggcgataacaggaaagagttggaatatgtcatcaaatactatgaaggggattcgttaaaaagagaggccgcccgctttttgatacgcaatatggtctatcatttcggatatgagaagcgagagagggtatcagacatcaccaccctatcctcggactatctaatccgtaatatcgagctggcgtttcaggcgtggcccaagccctggaataaatcggtaagtttcgagaatttttgcaggtatatacttccctaccgggggttatacgaaccgctctccggtttacgtgaggagctgatgcggacgtacctccctttgctggatagttcgcatattgataacacgtacgatgcggccgtgaggttacaaaagatactacgaacccgagtcacctatcaaacggagatacccatccactatccaaccgcagaggagatccaccggacaggggttggacgttgtgatggggtagtcttgtatggtatccagctgatgcgtgcggccggtattcccactgtagcagaacatacgatctggactcgtaggaacggggaacattattggtgcgcattcttaaacgaggatgggcgattcctacctttcgctccggagtacgaaggcccggattccttgatctacaacctaaccaagccgttcttgaccccggccaaggtttacagatacggattcgcccccttacatccggtaacgaccgagtcgaccgatgaataccgtacgttcttaaaaaatccgttattgaccgctgtcacggagcaatacctaccacctgtcgcagatatccatacgacttgcgacctcccggtgagatcaaaaagagcacctatttacctctgtacctataatcatggtaactggaggcctttcgccatgagcgaacggatcggcaaccgctgtaccttcccgaagatcgtaggcgatgatgtgtttatcatcgccgaatatgacaaagaggcttatggctcactacgcttcatcacatcccctttccatgtgagcaatacggggatcatcacgaaaattaagcccgatccggcccgaaccgattccatctttatcgcctcggacaacccgtatcaacagcaagtgccgtatacactcgcttattgggaacaggaacagcagtgttttaaaaacggatatttcccgacagacacgatacccggtggcatcctcattcgcaagatacctaaagggagcctgttgaaagcgatgatctcgcgaccggaaaaggctgcggaagatcgtatctttttggtggaaaacgatacggtaaaaagatattaaccatgaaagagctgttgaaactcggcgtatataccctactcgggacacttttgctaagcgcccctttcgcaggattgggaatgctatccacacacttggtgacagagaaaaccttttggattcaactaatcgccctgttcttatccgccgtgtccctacaaggtttgtggttgaatccaagcaaggggctgtgcccatggacttacgtggatatcctccccctttccctcttggggcttatcctcctctcttatccctactccatacacccggagccggaaaagctcctgtttatcggacaaatggttgtcttgtggtatctgcttcggcaggtgttccatgaatatccggtgctcataggatatttttcaatgttctttatcgcgacaggccttatagaagccatctggggcttccgtcaattacagggatgggcctattcgaaccattccctgtttcggctgaccggctcttttttcaatccggggccttattccggatatttggcgatcacattaccggtggctcttggcatcttgctggaacagtccaaacgaaatatgccctattacctgtccatgggatgtataggcacagcgatcgttgtacttcctgcgggaatgagccgatcggcatggatagcggtggtcgtttcttgcgcctgggtatatgccctgtaccgccttgacaggaaacaggcagcgaccagactgagacaacacaaaaggtggtatatcataggcggtatcctaggcggcatattgcttcttggcgggagcgcatcactctatacattaaagaaagattcggcagacggaaggtttctgatgtggaagatcacgacgaaagcgatacaaaaacaaccgattacaggtaccagcctaggtgggttccctgccgcttacgctgaaacacaagcggaatacatggcttcgggaaaagcgactgaacaggaaaagttggttgccggatgcccggagtacgcatttaatgaatacttgcagattggattagaacaggggttagtaggattagccctatttataggctggctggggcttctattttataaaggaataaagaacaaaaggtatgcttgttgcgggggattgatgtctatggctatattcgccttctcttcttatccattgcaattgccggagttttgggtagtattgatattcctaggggtgatgagcgtaacaccggacaaggatgagatccgtgagaaccaagccgaatcaaatggccatagatggggcaaacagatattttttatgggaatcgctattcttggaattggtttgttctggatgcaaaaagatcattataaggcttatcaacaatggaataaggcgcaaatgttttacaataataaagcttacgaagcggccttggaggtatatgaacctttgtatccattattgaagcataaaccggaattccttttcgaggtcgctcaatgcctaagcaagaccggacgatacgagaaagcgaatggatatctggaaagagctgtcttattaagctccgatcccatgctttattacgtaatggctaaaaatgagcagtgtttaggtgaataccgacaagcggaaaagcacctgttacatgccattgatattttaccggaacgtatctatccgtattatctgttaatgaatctttatacggaaccatcttattttcaacctgcaaaattgaaaaaggcgattgattccgtattaactaagaaacccaaagtggaaagttccgctattaaagaaatgaaagagaaagcacgaagtatgttaaacaacacatcaatatgaatacaatatccttatttttatagcaattacgactacatcgtaacaataaatacttatatttgcgaatgataaattgtacaaaccgatcaatcatacgagtatgaaatactataaattgttgacctttacgcttttattatgtttaagcgcatgcggaggagaaaagaaagatacagatgccacacaggattccgtagagaccgtattgccggatgaggcgaacgaagtcacgatcatgacattgaagcaaacggaatttaatcatgagttgataagcaatggtaaactgtccgctcgcaagctggtggacttacgatttgaatcggcggaaccgatcgcccgtatctacgtgaagaacggagaccgggtaaacaaaggagagaaaatagcggaactcgctactttccggctcacgaacaaaacagcgcaagccaaggatgccctagagaaagcgaggcttgaattaaaagacgtattgatcggtcaaggatatatgctggaagactcagcgaaagtcccgcctgcgacgctcaacctagcacgggtaaaaagtggatatgatctggcgctcgcccaatatcaacttgcccaatatgaggaacagaacgcgacgctaatcgcgcctttcgacggtattatcgcaaaccttttcgctaaacaagagaacgtggcgtctacgacggacgcattctgtaccgttatcgatcctcatagtctggaagcctctttcaccgtattggaaagtgagttgccgcttatccaaaacggagataaagtggaagttacccctttcgccaccaccagcttaaagactgaaggacgtatatccgagatcaacccgctagtggatgagaacgggatggtacaagtgaaagcggcggtaaacgacaaaggtaaattattcgaaggcatgaatgtacgggttagcgtacaacgctcgctcgggaaacaattggtcgtaccgaaaacggccgtggtattacgttccgggaaacaggtcgtatttactttagttgatgggcacgcttattggaactacgtgcgcaccggactggaaaacgcggatagttatacccttttggaaggattgaaagaaggggatgtcgtgattacaagcggcaatattaatctggcgcatgagtcaccggtcaaggtaattgaaaattgagaattgagaattgaaaattagtcgcgtatgattcgcttcctgctacaacgtccgatagcggtattgatggcttttacggcctgctttatcgtggggttggtgacttatttcaccataccggtctccttattgcctgatatcgccatacctgagattaccgttcagatatccgggcaaaatacatccgcacgggaattggaaaatactgtcgtaaagccggtccgtttgcaattgatgcaagtggcaggattacgggatatccatagcgagactcgcgatggagcgggtattatccgccttagcttcgactttggcacgaatacggatcttgcctttatagaggtcaatgagaaaatagacgccgccatgaattacctgccccgtgaggtagaacgtccacgggtggtcaaggcgagcgctacggacattccggtgttttgcctcaacctcacactcaagacaattgaaaatgatgccgctttcctcgatctttgccaatttgcggaaacagtaatcaaacgaaggatcgaacagttgccggaagtcgcaatggtggatatcacgggcatattaggacggcaattacagatcgtaccggatatgaagctcttggatatggctgatattacgttaaatgatttggaatcagccttgtctgccaacaatatagagccgggaagcatgaccgtacgggatggttattatgagtacaatatcaaattttctaccttattacgtacaccggaagacgtacaaaatatctatatccgtaagaatgaccggatcttccagataaaagatctggcaaaagtagctgtcgtaccggaaaaagaaaccggcttatcgctagccaacgggaaaagggccgttacattagccgttatcaagcaagcggacgagaatatggataatatgaaagaggcgcttgccgaggttaccgattatttcaagtctatttacccggatattgaatttacgatcacaagaaaccagaccgagttattggattatacgatctccaacctcaagcagaacctatcgttaggtttcttatttatctgcatcgtggcgatccttttcctcggggacgtaaaaagcccggcggtaatcggactaagtatggtagtcagtatcatcattagtttcttgttcttctaccttttcaatatgtccttaaatatcatctccctatctggattaattctggcattgggtatgatgatagacagctccatcatcgtgacggagaatatagcgcaataccgggcaaaaggagataatctggaagaagcgtgtataaaagggaccacagaagtaatcacccccatgcttagttccacatttaccacgatcgccgtattcgttccgctggtatttataagtggtatagcgggagcgattttcttcgatcaggcgtttgctgttacggttggtttaatggtctcttatttcaccggaatcatgttactgcctgtactttacaaattagtttacagcataccggagatcaagcattcctttttcaatctgaaaataaacaatttgatcaaggagcatacgctagaccgattctatgacggaggggttgatttcatattcaggcataaaaccactagcctactatttgtagctgtcactatccccctttgcgcaatcctattctatatgatccccaaaagccggatgccggaaatcgatcagaatgagttaatcgcacatgttgaatggaatgagaacatccatattgatgagaatagaaagagagtcaccgaattatttggtgaggccgatcggttaggtgcgcaacacacggcctatatcggacagcaacaattcctgctaaaccgagacagggaattatccatctcggaagtagagctttatttcaagacagaagagaccgatgctatcgcccctttacaacaagaaatctccgcttgggtaaagcgaaattacccgacagccgtattatcgttctctccgccggagactgtgtttgagaaactgttcgtaaccggtgaggccgatatcgtagccgagttctatgcccgtaacaaagaacaagctccggatgcccctactttgcaaaaactagagaaaacactagagagtaagaccggtctcgctcccgttggcgtagctttcgagaatcaattaaacatatccatagaccatcagaaactattactttataatatctcctatgaagaggtctacagggtacttaagacggccttcaaggaaaatgaaatcgctaccttacgctcttatcaacagtatttaccgatcacgctagccggaaacgagcaaacggtcgatcagaccttacaaaataccttaatccgtacacagccggacgaaaatcaaaagacgaatcatgtccctcttagcgcagtaacaaaaattactcccggagaggatttgaagacactcaccgctggaaagaacggggaatatattccttttagcttctatcaagtagagaacgcggaacagttaatggaaaatattcgggagctcgtccgcagcgaatccaaagataagacgaattgggacatcgatttctcgggaagcttcttctcgaaccaacaaatgctgaatgaactggtcgtcatcttgttcatatccattctcttgatgtactttatcttagcggcgcaattcgagagcttcttgcagcccttgatcgtcctgctggaaatacctatagacgtagccgcctccttactggtattatggatatgcgggcataccttaaacctgatgagtgctatcggtatcgtggtaacttgcggtatcatcataaacgactctatcttgaaactggacgcgatcaatgagcttcggaaagaaggtgtacccttgatggaagcgatccatgaggcgggtcgtcgccgtctgcgcccgattatcatgacctcattgacaactatattcggtatggtaccgctactattcacgttcgatatgggaagtgagttgcaaaagccactctccattgccatgatctcggcgatgctgatcggtacggcagtcagtttatttattatccctttggtttattggtttatctataggagacatgcattatgaaaaaaagatacaagaggacattcctagttttatatgcgttctgttcgctattagccgaaggagtatcggcccaatcgctcgtcctttcccttgagaagacgatctcattggccgccgatagctcgctggaggcttttcgtacgaaaaacctattcttgtccggctactgggagtttcgtaattacaaagcggagcgactgcctagtcttacattgaatatcacacccgccgaatattaccgggatatcacgaaacgatacgattcagaaaaagacatcgacgaataccgtaagcaacagtccttttatgcgggaggaaacttaaagatcaaacagaacttcgatatgctgggtggtagtttcttcgtggacacggatctggggtatatgcgctatttcggctcgaatacttataatcagttcacctccgttccaatccgtatcggatacagccaagatttattgggatacaatcctttccggtgggagaagaagatagagcctctaaaatatgagaaagtaaagaaagagttgctttataatatcgagaccgtcagcgaacaagccaccacttactttttctctttagccatggctcaagtagaatatgatatggccaaagaaaatgtagcgacaaccgatacgttataccgtaccggccaagagcggcataagatcgcggctattagtcaagcggatttactgacactcaagctggatgcgatcaatgcccgcaatacgttacaaaacgccgatatagccttgaagcgagccatgttcagtctggcctcgtatttgaatttcgataagaatacggagatacggcttcggctgccgtcacgcccccatgatatggatattccggtggatcaagcattgacgttagcccgggagaataaccccaagtttctggaagtgcggcaagaggtgttagaggccgagcaacaagtggataagaccaaaaaggaaaccttattcaacgcttccttgaatgccagtatcggtttcaatcaagtagcgacccagtttaaggaagtttacaagaatccgctgcagcaggacttggtatcgatatctatctctattccccttatagactggggagtacggaagggtaaatacaatatagccaaaagcaatctaaatgttacgcaaatatccgcacggcagacggaagtcactctggaggaagacgtaatcatgactgtcggcgatttcaatgtacagcaaaacctgatcgccagcgccgaagaggctttggacatcgcgatcatggcctataacgagaccaagcaacgtttcatgatcggcaaagcggatatcaatagccttacgctctccttgaaccgacagcaggaagcgcaacgtaattatatcacggccttgcaaaattattggttgagctattacaaaatacgtaagctcaccttacatgatttcgaaacaggcatctcattagccaacgaatttgattacgagcatgggttctaagccgaacatatcatcctttacgatcatcgtcaccttcctttgtatcgcattggcggggatcgctttcgtgcctttattgccgatcaagctatctccctcccgtacgctgccgaaattaagtatcagctataatatgccctccaactcagcgagggttatcgagatggaggtaacctcccggttggaggcgatgcttgcccgtatcaaaggaattaaagagatctcctcgacctcgggaaacggatggggaaggattaccttagaactagataaacatacgaatatagacgccgcacgtttcgaggcatcaaccattgtaaggcagacgtggccggaccttccggaagaattaagttatccgattttagagatgagccgtccggacgacaaggaatcacgcccattcatgagttataccttgaacgcttccgctaccccgatattcatccagcgattcgccgaggatcagataaagccccggcttagcagcgtgcaaggtatttatcgtatcgatgtaagcggagcgacccctatggaatggcgcttggaatacgatagccgccagctacgggatctggggatcacgatagaggatatccaatcggcgatcagccaatattacaaaaaagagttccttggaaccgctaatatgggacaaggagataccagcaaggaatggattcgtctggcgttaatgccggaaaagatcacgaatgggttcgaaccatcgcatatcaccgtcgcaaacaaagatggtagcttaatccggctggatcaattgataaaggtaacccggcaagaagaggccccgcaaagttactaccggatcaatggtttaaactctatttacctgtctatccgtgcggaagagactgccaaccagttgcaattagccaagaaagtgaaggaagaaatggaacatatccgcaccttgcttcctcccggttacgagatccataccagttacgacgctaccgaatttatccaagaagaattggataaaatctacgtccgtacaggcttgaccatcttgatcctcttgctcttcgttctgctgattacccggaatgtacgttatctgttcttgatcatcatcagtttaagtatcaacctgtgtatagccgttatcctttattatttattagggttggagatgcaattgtactcgctggcgggtatcacgatctctctcagcttggtgatcgataatacgatcgtgatgaccgatcatatccggcaccatcatgaccggaaagcgttcttgtctattctggcggccactttgacgactatgggcgccctcgtgatcatcttcttcttggatgagaagatacggttgaacttacaggatttcgccgctgtcgtgatcatcaatctggcggtatctttgttcatcgcactattcttggttccggcattgatcgacaagatgaatttacaccggaagaaagtcgcttcttcttccccaaaagcccggagtcattggagacaacatccggtggtccgtccgatacggtcgttcatacaccgtttcccagtctatttctctcattattaccgggcgcagatccgtttcctttgcaattggaaaaagctggcttgccttattctagtactggctttcggactaccgatatttttattgccggagaagatcgagccggaagagaaggatctatccgcaagggactctttgtggatcgctcgctacaatgaattcgcggcgaaaggtatttggaaggaaacgataaaacctatcgtcgataagagtttgggaggaaccttgcgcctatttgtccaaaaggtatacgagggaagttattttacccggaatgaagaaacggtattaagtatcagcgcttccatgccgaacggtacgacccttgatcaaatgaaccacttgatcaaccgaatggaggcttacttgagtacctataaggaaatacggcaattccagaccagtatctataacgcacgtcaagccagtatcaacgtctatttcacccgtgagaacgagcgaagtggtttcccctacaccttgaaaagcagggtgattagcaaagcgttggaattaggtggtggaagttggggcgtatggggacttatggaccaaggtttcagcaatgatgtccgtgagaacgcaggttctttccggatcgagatgtacggatataattatgacgagttatacgaatgggcggaaaaactacgggagaaattgcttacgtatcgccgtatcaaggaagtattgatcaattccgagttttcttggtggaaggatgattatcaggaattctacttcaacttgaataaatcccgtatggcgcaagcggatatattgcctatcgatttattcgcatctatccggcctgttttcggtaaagatatctacgcaggtaccatcgtcgttgataacgagacggaaaagctaaaactttcttctcgccaatcaaaggagttcgatatctggagtatgcaatatgtacctcaaaccatccgtgataaatcctataagttgtccgaactcgctatcgtcgagaaaagccagacccctcaacagatagcgaaagtaaaccagcaatacaggctctgcctgcaatatgaatatatcggagcctcctcacaaggcgagaagatacagaaaagggaacttagagagtttaacaagatcctgcctatgggatatacggctaaagcggaaaagaactattggtcatgggatcagaaagataataaacaatatgcgttattattcttgatcatcgttattattttctttacgaccagtatcttgtttaattccttgaaacaaccgctggcggtcatttttgtcataccgatctcttatatcggggtattcctgaccttctattggttcaaactgaacttcgaccaaggtggattcgcctccttcgttttattatgcggtatcacggtaaacgccagtatctatatcttaaacgaatataaccaaattcgggaacggatacccgctatttccccaatccgtgcttatctaaaggcatggaacgccaagatcacaccgattttcctaaccgttatatcgaccatactcggatttatcccgttcatgctaggcaccgataaagaagccttttggttcccgctcgccgccggaacgataggcggccttatcatgtctatcctaggcatcttcttttatttaccgatatttacgctgaaaaaagaacggcattaaacaggaatacgtatctttaacggataaatcgttaatcaaattcattaaacttatgagacacataaattatttagtattgcttctggtagcttgcagcgtaggtgcttgcagttccccgaaaaatgatacgaaagatgcttatccgatgttctggacttggttggattaccagcccggaatgaatttcgactccatctgtacgatcatgaatgaggcggggatagacggtgtcatgctaaacgcccctactccggatgattatcgggccgctattcccatcgcccagaaacatgggatagaggtctacgcttggttatggacgatgaatccggaacatgaccgagacgctatcttaaaagaacatcccgaatggttcagcgtaaaccgcaatggacaaagcttggccgatacgaccgcttacgtggattactacaaatttatgtgccccgccttacccgaggtacgggagtttatcaagaagaaaatagaggcttactgcgaggtagagggtttgaacggtatcgctatcgattacaaccgtttcgtggatgttatcctgccgactaccctttggccgaaatacggtatcgtgcaagaccaagaatatccgcaatgggattttggttatcacccggccatgatcgagaagttcaaggccgcttacggatatgatccaagagaacaagaagatccctcgcaagacgagaaatggctccaattccgttgtgaccagattaccgaggtcgctaatatgatcgccgacgtggttcactcttacggcaagaaaatggcagcctctcctttccctacgcccaagatggcatccaaaatggttcgtcaagactgggggaaatggaatctggacattgtcttccccatggtataccataacttctacacggaagatattagttttatctcagactgtatgatagaggatgtccgggataagaacccgaaaaccacgctttactgcggactgatggtagccgacgatatagagaatgccatggatgccgcactgaatcatggggcggaaggaatctctatctttaccgtatccgctttgcgcactccggaaagccgtgcgatgttcaaggcttatgcagatagtgttcgtgcggttcgtgccgagaacaatggggtgaatccggctttatccaagagcaccaaagtaacgaatcctttcgagagcatggatatcttgaataggataaacgcaaagatcaaagaactcgccaacgtgcctattccgaatatcgccgattataaattggtgaacgaaaaaggtgccacgaaatactacgaggtcaaagagctgaacacaggaaagacattctgcgtagacttttacttctacggaggtattctttccggatggaatgttacggttaaataagtacttgataatagctatttttacgcggcctacctcgtaaattcatgaggcaggccgcatgcgtaaacacccctattccagaacgccgaaacaaacaatcacctttaacgaggagacacctcgcctcattgaagggaacttgcccttattaccgtccgaacaagaaagtacgctatgccgcgggattcgtaagcctattggagagcttgccacacaaacagatgctctccgttatcccgggactcatgaggcacttcagccggcgcacttactaccgtgtccgcaagggagaaaggccgctctcaccctccgagcaacaggtcgtattgaatgcgcttaaacgctgtggggtgaaggaaccaaaagacttcgacgcttatttcgaggagtacgactggtaaaccaaggaagagaggcttgtgccattacccatgttacggatgtgccatcaccgtggcatgcgtgtgccatcgcagtggcacgcctttgccatcgaggtggcacaactgtgccaatagcatggcacatcattggcaccacaaagtactattaataaagcaattggaataatatcacggagtcacctcccagcatttccatcctttgttggcacagatatatacaatgtaggaacggacatgatagtgtgggaacttcaccttggtatccttggcgtaggcgagcacttgcgccacgtcctcgggacggggatcgctgagcgccagcatgcgctccgcttctttcgctttgaaatacttgaattccgccaaccggtcgtccttgtaatagtccgtgccggggataccggtcatctcgaaatcggaacgtcccgccgaattgttctgctcgatggcgaacgtatagcagctgctcaggtaacgggaacaaagctcgaagaaggagcaacggatgaaattctcgttgatcttgtcgaacacctgcgcagggaactgaccgaggtattgctcgaagtagttttgcaccagcggctcaaaacgacgctcctcggtgaaacgctcgtaagtggggacatagcgttgggcatttccctcgatatgattcatctcgttgtaatagtccatgtagatgctgcgtatcgtgaggttgggcagcaccatgcggtaattactccgcagcgtggtcatgcccagataaaagaggctgaccggatagatgctcttgtcgaagaatttcctcttgttgaacttgctggacaggtcggaaacgttataggacaactcatcatcgatcaccaaggcgtcctgcatctccttggcgttctcaagggaaagagtcagatgacggatccaaccgatatccgtacgcaggttctcatccaccagctcactagggattccacctttacgaacggcgaatttcttgaagaaataggtcaggatcgtggaattgaacaagggttcggcctccggcaagaagcgataaccatcgtaattattcacgatcaattgccaaacatcatcgaaccgatcctgcccctccgtataggtatccagcacgtaacgcaagtagacctccgcttccttatacgtgaagcccagcatactcaggaattccggttccaaggtcaggatctccgctatattatatccgcttgtcaagtcatccatcgtaacgggaagaacccccgtgcagaaacaggtacggatcgccaatacccgccttgatcaccttgaagaaggtgcgcaggaaactgtccttcgtggttacctgctcatagagcggatccttgtaggccgtcaatagctgattggtgaaattatcgtactcatcgatcagcacatacacttttggcaatccatgctcgcgggcgtaccccaaagcttcctcaagcatcttggaagcatcaccacggctagagaaccggaagtccttaaaacaagtcccggttatgcgtcaccatgatctccaccgcagaacaattcaggtcattgaaattccgttccaacccctccatgtcatcagccatcaccatcttggagaaatcatagcgcacgaccatataccgattatgttcctccgtcgggtgctcaccgatccaagtcctgccgaacagctcctcgaaccgatcggccttggtgcggtcatagtaacacgccaaggtagagataagcaaactcttgccgaaacgccggggacggagaaaacaggagcgttataatcttccaagctcgggatgaaatcggtcttatccacataataataaccacgttcccgtaaatctacgaaatccgctaccgcataaggaatcgttatccgtgccataagctttcttttttcagattagtcgcacaaagataaaaataaaaagtgagataaagttatatccttcacgaggcaggctaggcgaaactataattctgaatattcacttctagttgaatctaggacctaaaatattctatttttttcttgcacgcttaatttttttgataacttgcgcacatactagaacgtagataacgtttatcattctgcttacaggtcgcttttcgtatagctatattgcaatatagcaaacgaaaatgaaaaaaaccggtataatcacttatccggtccctctcaattaattcatcagttacatgactatccaataaatttgtttaacttaaaattcaactatatgcaaaaactaaaaacaaaaataacaggacttgcatttttcttagtcatagtatgtataagctgtgataaagatgataggctggtcggctttgtaagcatgattgcgctcgaaaataataatatctgtcttgtagcaattcatgaaggtccgaagcttggtgtaaccggcttgaatttctcgaatgccatacaactgtatatccccgataatcgtacagttaagcttgcctatacaataaaattcaattgtagagcttatgatccagccatagatggtgtgatattggatgcttttaccatacctcacccttcggaatcttatgacccacgggacccaaactctgaatatctttcgaacaaagtccctatgtatattgctgaaaatgttgaaataattaaatacgaactggaatgaaaacaaataatttgatatatcttttagtgattgtgcttttgtcttcaatacattgcgatgttaatgcgcaatattattggtcacaaaataggaaaatcgctttaaccccagactcatcacaccttgtgttgaatatagaagccgatttaatccgaactccaatgctaagttcggattataagggatttaatgaaatatcgccgaacatcattgtaaaagaaaataaatccaatatcttttctgaaaatgattttaaagcatacgagtcggatcctttagtgaaaagagcttctcctgcttatttagtaaatggaacagatacattgtatgtaactaatcatatactgcttaagcctaaaaatggcgtaagtattgattctatattagcaggtatgaatgagatagtagaagttgttgatcaaactaaatatggggtttacacattatccgtgaatcaagggtttgatgttttaacttatgccaatataatatatgagaatggtttggtcgatttttgtcatcctgactttataatgagaataactcaatttctgaatgaccctctttatagcgaacaatattatttaaataatacgggacaattaggtgggacgtggaatatcgatattaatgctcctgaagcctggagtatgacaaaaggtagttcttcgataaaagtggctgttatcgatcaaggtgtggcagggcatgaggatctgggtgatagacttttgccgggttttacgccgggtttagccaatgggaatggagcaccagtctcaaataatccacatggagaatgctgcgctggtattattggagcttctcataacaatttaggtatagcagggattgcccctctagtgaaaatagtccctgttaatatattttatagtcaatctagttctaatattgcagctgcgataaattatgcgtgggatgatgctgaagcagatgttattagtaactcttggggtggttctgtagctgatgcaattacctcagccataaataatgctagaacgaatggacgcggtggactgggatgtgtagttgtttttgcagcaggaaattctggttcctctgtttcgtttcccgcaactgttaatggggttatcgcagttggcgcagttgataaaaatggtgctttgtattcttatagtgcaagaggttcagaaattaatctggttgcaccttctggtgccttggattatacaggggatattcgcacattggatttaatggggagtgccgggctttaccccggaaattatctctctacttttggaggaacctcagcgagttgccctcaagtttcaggcgttgcagcactcctactatctattaatccaaaattgacagaagctgaagttcgaaatatacttggacactctgccagaaaaattggatcttattcttactcaacagtttcaggacatccatttggaacttggaatgccaatatgggatatggtttgcttgatgcagaggcggctgtccgagaagtatatccccaaatatccggcgataatttagtgccatgtaccggaaataaaacctacacgttaaatcgtaattataaggggaattggacattaggaaccagtggcctacaaattgtaagtggaggacagaatagtaattcaatcacggttcgggctatctctaatccgggaggaacaatgagtggtacgatttatgcgaatgtggtacttcctaatggctcttcagtttctgtagcgaaaactgtttctatcggtgccccatccataacttccgtgtccggtccggatcaagtaggggctggtggtagtgcatcttttacggctagccctatatttatggaagacgaagggaattatcaatggatggtcagtccaaacacggctagcatgtctgcctatcggtattcaaacagtgttaccttctccgcaccaggaacttatattgtgggctgtcgttcaaccagcacttgtggaacacccgggtcttatgtgataaaaacagtatctgttacgggatattattattctgtttcaacttcctcatccactcatatggttaatatttcaaaagaaactcaaatccaagatcaattcagtgttatgttagagactaggccaacctatactctatataaccaatcaaccggagcattagtaagggaggggacattcttgagagaaggagatctcttagattttaatacattaccttcgggcatctatgtattaagactccaaataggcaatgatacttatgaaacacataagattgtttttaaataatggatgtgttaagctggatttagaggctgttaaacacagacaatactatttcagcatagattttcgcatttaagctttgttctttcagacataatccatacctttgccgaaattttgaagagagagcagatgacaaacaagacacataaggataatccgaagttctattccggttatatgtcggaggttgaggctcttttctctattttacgggattataatttggttatataagatgcgttggttacttttactaacgcattttttttgtgtccagcggtccggtgatataatataaaggtataatattctaaaatcattataataaacaaaacaacccaaattactatgtcgaaaagtgatatcaaaaaggtgattgttctgggctcgggtgccctgaagatcggacaggccggggagtttgactactctggctcgcaagcgttaaaggctctgaaagaagaagggatcagtaccgtattgctaaatccgaatatcgcgactatccaaacatccgagggagtagccgataaggtatatttcttgcctatcactccttacttcgttgaggaagttatcaaaaaagaacaaccggacggaatcctattggcgtttggcggccagaccgctttgaactgcggtactcaactttacaccagcggcacgttggctaaatatggcgtgaaagtattgggtacatccgttgaggctatcatgtacaccgaggaccgtgacctatttgttaagaaactgaacgagatagaagtgaagaccccgatcagccaagccgtagaaagcatggacgacgccgtggctgccgcttacaagatcggtttccccgtaatgatccgttccgcttacgcattaggtggtatgggcagtggtatctgcaaggacgaggccgagcttcgcaccttggcggaaagcgctttcgcttactcatcccagatcttggtcgaggaatctttgaagggttggaaagagatcgagttcgaggtgatccgcgacaagaacgaccattgcttcacggtagtgagcatggagaacgttgacccgctaggcgtacacaccggcgagagtatcgtagtggctccgacttgctccttgaccgagaaagaattagacctgttgaaggaactttctaccaagacgatccgccacttaggtatcgtgggtgaatgtaatatccaatacgctttcaactccgagacttgcgattaccgcgtgatcgaggtgaacgctcgtttgagccgttcttccgccttggcatccaaggccagcggttatccattggctttcgtcgccgctaagttggcgttgggctacggattggacgagatcggcgagatgggtaccccgaactccgcgtacaaagcgccggaggtagattatatgatcgtgaagatcccgcgttgggacttgacgaagttcgtgggtgtcagccgccagatcggttccagcatgaaatccgtcggcgagatcatgtcgatcggtaagagcttcgaggagatcatgcagaagggtcttcgtatgatcggacaaggaatgcatggtttcgtaggtaacaacgatatccacttcgataacttggacgaggagttggcgaaccctaccgacttgcgtatcttcgccgtggcgcaagccttggaacaaggatatagcgtagacaagatccatgagttgtcaaagatcacacgctggttcttggaaggcttgaagaatatcgtggattacgccaacgtattgaaaggctacaacaagatcgaggatcttccggaggatgtattgaaagaggctaaacgccttggtttctcagacttccagatcgctcgttacgtagagagcccggaaggcaatatggagaaagagaatatccgcgtacgcaacttgcgtaagaaaatgggcattctccctaccgtgaaacgtatcaacacgatcgcttccgaacatccggaattgaccaactatctatatatgacttacgacggtacgccgcacgacatcacctactacccgaatgagaagagcgtgattatcttgggctccggagcttaccgtatcggctcgtccgttgagttcgactggtgttcggtgaatgccgcccagaccgctcgtaagctaggttataaatcgatcatgattaactataacccggagaccgtatctaccgactacgatatgtgcgaccgtctttacttcgacgagctttcattcgagcgcgtgctagacgtgatcgatctggaattgccgaagggcgtaatcgtctccgtaggtggacagatcccgaacaacttggcgatgaaactctaccgccagaatgttccggtattgggtacttccccgctatcaatcgaccgtgccgagaaccgtcataaattctccgcgatgttggattcgctaggtatcgaccaacctcgttgggcagagcttaccagcatggaagagatcgacgcgtttatcgagaaagtaggtttcccgatcttgatccgtccgtcttacgtattgtccggtgcggcgatgaacgtttgccatacgaaagagcagatgattgagttcttggatttggccgctaaggtttccaaggaatatccggtggtcgtatccgagtttatgcaaggaacgaaagagatcgagttcgacgctgtcgctatgaatggcgaggtggttgagtatgcgatctccgagcatatcgagttcgccggtgttcactccggtgacgctaccttggtgttcccggctcagaagatttacttcgagacagcccgtcgtatcaagaaagtaagcaagatgatcgcgaaggagttaaacatcagcggtccgttcaatatccagttcttggcgaagaataacttcgtgaaagtaatcgaatgtaacttacgtgcctcacgtagtttcccgtttgtatctaaagtattgaaacgcaactttatcgagacggctacccgcatcatgctggacgctccgtatacgaaaccggataagagcgcattcgatatcgactggatcggtatcaaggcttcccagttctcattcgcccgtttgcacaaggcagaccccgtattaggtgtggacatgagctccaccggcgaggtaggttgtatcggcgacgatttcaacgaggctttgctttccgccatgatcgccgtaggcaacagtattcctaagaagaacattttagtttcttccggcgcagctaagagcaaggtcgatttattggagccttgtcgcatgctggatgccaagggttacacgatctatggtacgcacggaaccgccaagttcctgaacgacaacggaatcaaggcaaccgcagtttgctggccggatgaggaaggtgatttgaacatcatggatatgttcagcaatcacgctttcgaattggtagtaaatatcccgaaagatcatagcaaacgtgagttgaccaatggctataagatccgccgtgcggcgatcgatcataacattccattgatcacgaacgcccgtctggccagcgcctttatcgacgctttctgcaatatgaacgtagaagatattcagattaagagctggcaggagtacaaataatcaaaatttgattatatttgcatgcgtgtaatagaaagagacaaggctttatgccttgtctctatagtttaaagaccatgtacagacggctaccttttatcatattattatctatactggcggttttcgccttgcgtgcgtctgtggtcgctccctctatcctcgtacaaaattattccgtagacgattacaaggctagttgccaaaattgggatttagcggtttcctatcatggcatcttatatgtagctaataattccggtctggttacttttgacgggaatacatggaacacatatccattaccggataaaacccctatttataaagtatctttccagaacgattctatctatacccaaggcaaatcatcgttaggctattggctatacgacaaactcgggaatctggaataccatccgatcgatacgctcccgtcatatataaattttgatgatcccgagacgaattacacgatcccgaaagaaatcgaggagaagcacccaacttccttcgctagcgccggaggtctcaatttcacgggaacatctacgtccggtatttatatcaccaacgacgaaggggagatctttcaacatctcaacatcaataatcagttacaagataatatcgtacgctccatctgcgtacaggataataatttaatctgggtcgccttggataatggtatctcccaaatagatatcaatcctcccatcgccatgttaggtaaaagaagccagatcggaaagttggaagacgctgtaaaagaggataaccgcctctatatccggaccaatgtcggctacttcagccggagcctgatgtttggtgataagtttaccccgatatccgatgagatcggacgttcatatatccatccggatacgaccgataatcatttatcggtaagctctttatttaagaataaagacgtattgagcgtattcgccaacgcagaaagtatttacccggttccagacaatttgtattggctcacgatccagaatgaggccggactcttccatcgggaaaacggtacaggaactttaaaatgccggatcctattcgataattacgatctgaatctggtaaccaatggcaaacggatcatccccttgaatgattctcttgatttggtatctgccatgcaaggaaccctattaatcaacactcgtcaattaatagagggaagcctaggaggattgacgatgccacggtttatgcgcatcgagtatcaagatcaagaaggtacacattatttatatccggacacgcaaagaatcgacctgccccataacttccaagaactctcgctatacatcggaacaacggtattcacccctaatcaccaaatcagttataagctggaaggggtatccgccgattggtcttcttggcagaaagacggcaaaattaccttcttacaacttccggaaggaacttatgagctaagggtacgtaaatatgtaacccgtgggccgtttcccgagatcacgatgcaaatcacggtgcgccctccttggtataataccgtatgggcctatttgatctacgtcgctttgatatggttcgccattcaagaaggacttcggtaccatttaaggaatttgcggaaaaaagaacaagaaaagctggaggcagagcgacaagccgaactgcaaaggcttcaacaaatgaaaagcgagatgctggaaacggagttgcaaaacaaaaacaatgagcttactctccagacaacagctttggtaaaaagaaacgaggcaatccaagctttgttggaagaactggataagcagaaagagacattgggtgaccgataccccaataagttatatacccgtttacgttccttgatcgaatctaccttgaacgatcaagcggattgggtgcagttcgagacctatttcaatagcgcccaccagaatttcatggatcgtttacgccagcaatacgcagatataacggcaggcgatttgcgtatttgttgcttactccgcatgaacctttccacgaaggagatcgcatcgttaatgaatgtatccgtacgggctatcgagctaagaagataccgcttaagaaagcgattagcccttgatggggatacgaatcttgtcgatttcctgatgaactactaaaaatattttccgagaatctcaccagaacgcccgacgggttggttatacgtcctccaattgcacatggctaccggaggggaagaaagctacaagatcgtattgaagtaaaaaattcttcccgaaaatgatctctcgacaaactcaacatctaacatgaataatttattccgggaaattttcacatggaaatcattacactatcaatatatatatatttgtattcaaacttttgtttcacttaaatttaatgatgtatgggaaagagattttttaaattcacggcgttaatcagtttgatctttttcgctataaacgtagatgttttagcagaaggtgacagtgatgatcatgcttgcccggatggcgaccaaggcccagtcataagctgcggcagatatgaggggacttgctggaatgtagattggataagtggtatttattatgtgcattgttatttctcaggaatgcaagaacatcattgttatccagattaaaaagcatgaaaagtatcatctattatttttcgatgatatccatatttttctttctttcttgtacgggatggaaggataagaaaaatatggaatcagatatcatcaccgtgaatttggacgagcgagacgagatctccactaaagatctattttctgagatccaactcattccgttagagacaacgccagaatcgctgatccgtaatataacccaaatcaagttttttgaggatcgatattatattcacgattattcgagatcccaaatctttgttttcgatagggagggacatttccaattcgcgcttaacgagaaaggaaacggcccgggtgagtatttaaacttaacagatttcgcgatcgatacgacccgcaggaaccttgtagtactttgcgccgtcagcaacgctctctttttctatgatctagggggcaagttcatcgagaaaaagaaacttcctgaaatagcgggggcctacaacagcctacagttccaaaacaaggatacgatagctttcttcacatacgattacgaccatcgcttgaagttttattccctatcaagaaacgagatactcgatgaatattttcctgaagacataaaagatgtattttgtaggggtgtatttccatttccacacgcttttcgaaggtctttgactaatacgatttattcactatcgggagcgacctttacagagctttatcgttgggattttggtgatttaaataatgacatcgaaaaattagaattccatcccaatatgagcaagcaagaaataattcaatacgcgaaggatgtctattcctctaagagcgtaaattatataatagactctcagggacaaaacagcagatatcgatacgccatggtagtccgccaaaacaagtacatccaactgttttataacaggaaaaaccatgacttgcttcaattcgagcgaaccaaggagggcttgcaactttacccgatctacttcggagaagacttcatcctctgtactccggaaggagggcttccattaaatgatctatttcccgagaagttaagaaatgaggatcagcaaagaattattcaatcacattcggaacaagagaatcctgtcttagtaaaatatgttttcaaaaatgaaggttaacgagaatacaatttatattttccttttggggatactggcaggcataatttgtatgcaatgcgtgaatcattttagaaaatccccgaaggatgtgtatgttgacaattttgaatacgagaaagaaagtctgggtatccttaaaagagaagaactaaaaaatgaacactatgaatgccttgatcaaatagcctattggggaacagactctctagattctttctccttaagtaatttatgtaatgataaaaaattattcttttgtttttcagagaaaacatgtcctccttgtatcgatgcagttgtcgatataatgaacgaggtttttacagacgaggaaataaaaacaaaaatagttttcgtatcgcctgattatcctgctcgattaagaaacgattgctatgggaaaaaactattgagcttacataataagaatttagggctacctatggaactagaagattctttcgctcctttcttattcattatggataaagatttatgtgttaaatatttacatattcacaataaaccactcccacgacttactttaatttatctggaagagataaaaaaaatgtggtagatcttattgcggttgatcgtacgatattaagccgcaggctgttaacgaggatgggaaggaggatttgatcatcgtcggaagctttgaggaagcggaaggaatgatcgaagaaagaatcgtgttggaattggaggatgtgccagcgtatctctggcttccggatcgcatcactttagaatctcgcaaaaagtgagtcttatataattttaatctatttgacatataatatactatataacagcatagtatatatatacaaaaggagcttgagaaagtcttgtagtagtcttatccaataaaaaaatcatttgcgcaagtcgtgtagtagtcattttcatggctaccgtaatttattgtgtttcctttgccagcgaataaaatcttaaattctttcgacatgatgaaacacgaactggagaaacaattagatgcgctagaaaagaaaggtgtcgaca
